US012559470B2

(12) United States Patent
Zhang et al.

(10) Patent No.: US 12,559,470 B2
(45) Date of Patent: Feb. 24, 2026

(54) FGFR INHIBITORS AND USES THEREOF

(71) Applicant: University of Southern California, Los Angeles, CA (US)

(72) Inventors: Chao Zhang, Los Angeles, CA (US); Renata Rezende Miranda, Los Angeles, CA (US); Feng Ni, Los Angeles, CA (US); John Carpten, Los Angeles, CA (US)

(73) Assignee: University of Southern California, Los Angeles, CA (US)

( * ) Notice: Subject to any disclaimer, the term of this patent is extended or adjusted under 35 U.S.C. 154(b) by 645 days.

(21) Appl. No.: 17/275,601

(22) PCT Filed: Sep. 12, 2019

(86) PCT No.: PCT/US2019/050806

§ 371 (c)(1),
(2) Date: Mar. 11, 2021

(87) PCT Pub. No.: WO2020/056132

PCT Pub. Date: Mar. 19, 2020

(65) Prior Publication Data

US 2022/0048883 A1 Feb. 17, 2022

Related U.S. Application Data

(60) Provisional application No. 62/730,921, filed on Sep. 13, 2018.

(51) Int. Cl.
*C07D 401/04* (2006.01)
*A61P 35/00* (2006.01)

(52) U.S. Cl.
CPC ............ *C07D 401/04* (2013.01); *A61P 35/00* (2018.01)

(58) Field of Classification Search
CPC ............................... C07D 401/04; A61P 35/00
See application file for complete search history.

(56) References Cited

U.S. PATENT DOCUMENTS

| | | | |
|---|---|---|---|
| 7,687,512 | B2 | 3/2010 | Bilbe |
| 9,708,318 | B2 | 7/2017 | Lu et al. |
| 10,047,058 | B2 | 8/2018 | Zhang et al. |
| 2009/0069327 | A1 | 3/2009 | Ding et al. |
| 2016/0244449 | A1 | 8/2016 | Lu et al. |

FOREIGN PATENT DOCUMENTS

| | | | | |
|---|---|---|---|---|
| CN | 108368174 A | | 8/2018 | |
| CN | 113795256 A | | 12/2021 | |
| WO | WO-2005033086 A1 | * | 4/2005 | ......... A61K 31/5377 |

OTHER PUBLICATIONS

Golub et al. Molecular classification of cancer: class discovery and class prediction by gene expression monitoring. Science. Oct. 15, 1999;286(5439):531-7. (Year: 1999).*
N. Rothman et al. The use of common genetic polymorphisms to enhance the epidemiologic study of environmental carcinogens. Biochimica et Biophysica Acta 1471 (2001) C10̂C10 (Year: 2001).*
Sara Cheek et al. Sequence and Structure Classification of Kinases. J. Mol. Biol. (2002) 320, 855-881 (Year: 2002).*
Brown et al. Classical Bioisosteres. Bioisosteres in Med. Chem. Wiley-VCH Verlag GmbH & Co. KGaA, 2012, p. 15-29 (Year: 2012).*
Weiyan Cheng et al. An overview of the binding models of FGFR tyrosine kinases . . . European Journal of Medicinal Chemistry 126 (2016) 476-490 (Year: 2016).*
CN Office Action in Chinese Application No. 201980060055.2, dated Dec. 16, 2023, 19 pages (with English translation).

* cited by examiner

*Primary Examiner* — Kortney L. Klinkel
*Assistant Examiner* — Richard Grant Peckham
(74) *Attorney, Agent, or Firm* — DLA Piper LLP (US)

(57) ABSTRACT

The invention provides novel FGFR inhibitors based on the pyridinylpyrimidine. The invention includes inhibitors with broad inhibitory activity against all FGFR isoforms, and inhibitors with selective inhibition against FGFR4. These novel pyridinylpyrimidine-based FGFR inhibitors, or their derivatives, have strong potential to be used to treat cancer.

23 Claims, 1 Drawing Sheet

Specification includes a Sequence Listing.

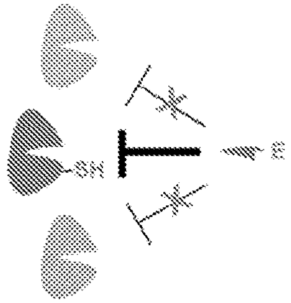
*Subdomain V*
```
FGFR1    -IVEYASKGNLR- SEQ ID NO: 57
FGFR2    -IVEYASKGNLR- SEQ ID NO: 58
FGFR3    -LVEYAAKGNLR- SEQ ID NO: 59
FGFR4    -IVECAAKGNLR- SEQ ID NO: 60
```
FIGURE 1A FIGURE 1B
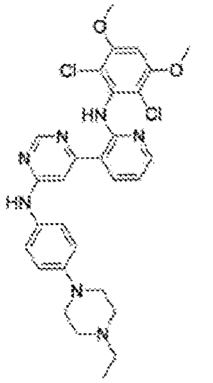
1
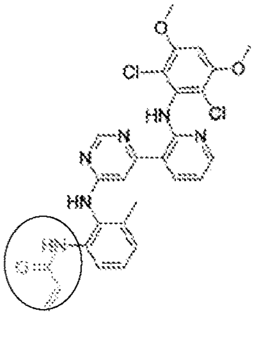
2
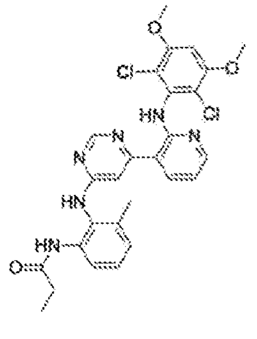
3
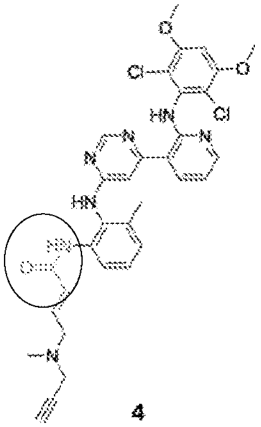
4
FIGURE 2A FIGURE 2B
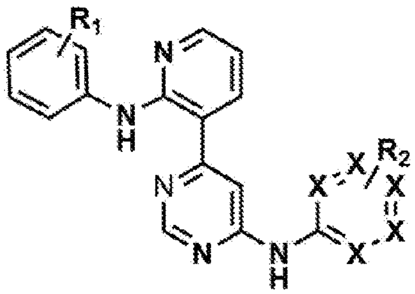
FIGURE 3

FGFR INHIBITORS AND USES THEREOF

CROSS-REFERENCE TO RELATED APPLICATIONS

This application is a 35 USC § 371 National Stage application of International Application No. PCT/US2019/050806 filed Sep. 12, 2019, now pending; which claims the benefit under 35 USC § 119(e) to U.S. Application Ser. No. 62/730,921 filed Sep. 13, 2018, now expired. The disclosure of each of the prior applications is considered part of and is incorporated by reference in the disclosure of this application.

INCORPORATION OF SEQUENCE LISTING

The material in the accompanying sequence listing is hereby incorporated by reference into this application. The accompanying sequence list text file, named USC12801_ST25.txt, was created on Mar. 3, 2021 and is 1,084 KB in size. The file can be accessed using Microsoft Word on a computer that uses Windows OS.

BACKGROUND OF THE INVENTION

Field of the Invention

The present invention relates generally to novel fibroblast growth factor receptor (FGFR) inhibitors, and more specifically to the use of pyridinylpyrimidine-based pan-FGFR and FGFR4 specific inhibitors for the treatment of cancer.

Background Information

The human family of fibroblast growth factor receptors (FGFRs) is composed of four receptor tyrosine kinases that bind 18 ligands called fibroblast growth factors (FGFs). The four members (FGFR1, FGFR2, FGFR3, and FGFR4) are highly conserved among each other and consist of extracellular ligand-binding domains, a transmembrane segment, and a cytoplasmic tyrosine kinase domain. Upon binding of ligands to the extracellular domains of FGFRs, the kinase domains are activated by autophosphorylation and then phosphorylate cytoplasmic substrates, triggering downstream signaling cascades that control cell growth and differentiation.

The FGFR signaling pathway is an important and validated target for cancer therapeutics since it plays a crucial role in tumor proliferation, angiogenesis, migration, and survival. Mutations and overexpression of FGFRs and their ligands have been reported in several cancers, such as breast, lung, bladder, prostate, and gastric. For instance, amplification of FGFR1 has been found in about 10% of breast cancers (predominantly in estrogen receptor positive diseases), in 10-20% of squamous non-small-cell lung cancer (NSCLC), ovarian cancer (~5%), and bladder cancer (3%). FGFR2 amplification has been detected in gastric (5-10%) and breast cancers (4% of triple negative cases), and mutations in FGFR2 occur in 12% of endometrial carcinomas. FGFR3 mutations were identified in about 70% of non-muscle-invasive bladder cancers and 10-20% of invasive high-grade bladder cancers. Amplification and activating mutations in FGFR4 have been described in 8% of rhabdomyosarcoma patients. In addition, many preclinical studies have reported FGFR4 overexpression in prostate, colon, and liver cancers.

A number of FGFR small-molecule inhibitors have been developed and evaluated in clinical trials for the treatment of cancers, but most of them are pan-FGFR inhibitors with promiscuous kinome activity, such as BGJ398 and LY-2874455. It has been found, from sequence analysis, that FGFR4 contains a cysteine (Cys552) located near the ATP-binding site, in the hinge region of the receptor, which is unique within the FGFR family and rare among other kinases. In fact, the first selective FGFR4 inhibitor, BLU9931, was discovered recently targeting this unique cysteine and exhibited very good specificity and significant antitumor activity against hepatocellular carcinoma in vivo. However, the potency and bioavailability of BLU9931 is suboptimal for clinical applications.

SUMMARY OF THE INVENTION

The present invention is based on the seminal discovery of novel pyridinylpyrimidine-based compounds that are potent pan-FGFR and FGFR4 specific inhibitors. Further, the pan-FGFR and FGFR4 specific inhibitors can be used as targeted therapies to treat cancer.

In one embodiment, the present invention provides a compound of Formula (I)

I

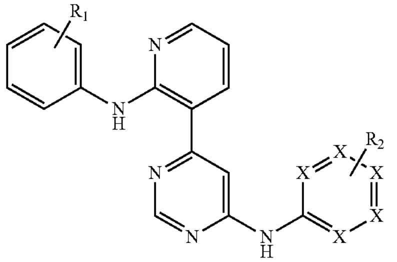

or an optically pure stereoisomer or pharmaceutically acceptable salt thereof, wherein X is CH or N; R1 is hydrogen, halogen, or methoxy, and n is 0-4; and R2 is hydrogen, methyl, amino, or propargyloxy, and n is 1-2.

In one aspect, the compound is

1

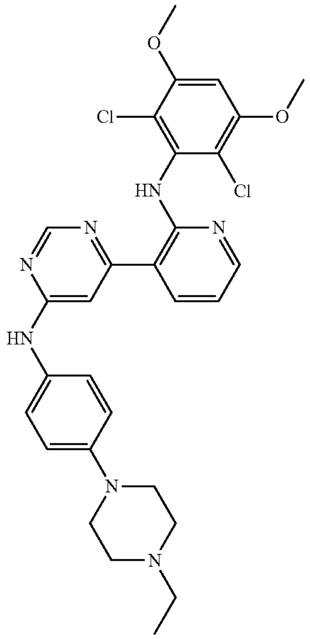

-continued

2

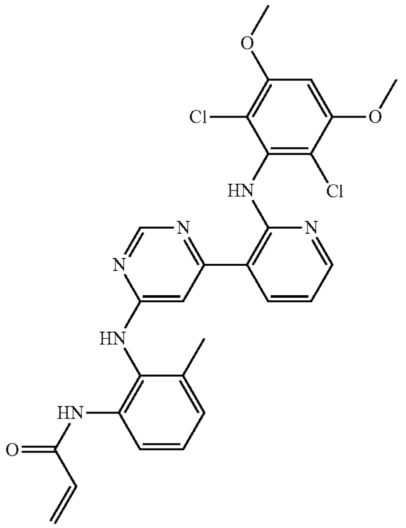

3

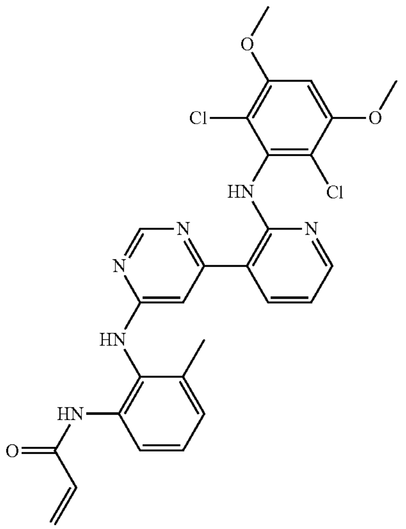

-continued

4

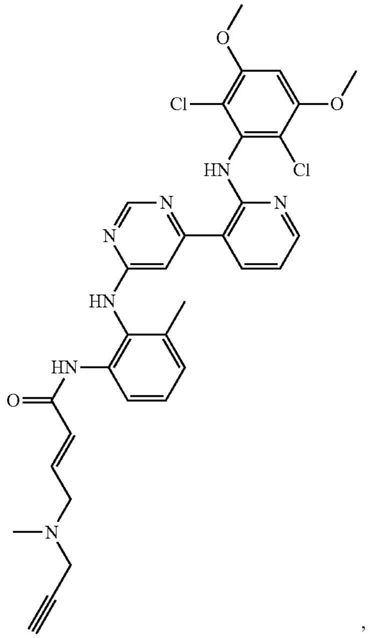

, or an optically pure stereoisomer or a pharmaceutically acceptable salt thereof. In an additional aspect, the compound is 6-(2-((2,6-dichloro-3,5-dimethoxyphenyl)amino)pyridin-3-yl)-N-(4-(4-ethylpiperazin-1-yl)phenyl)pyrimidin-4-amine; N-(2-((6-(2-((2,6-dichloro-3,5-dimethoxyphenyl)amino)pyridin-3-yl)pyrimidin-4-yl)amino)-3-methylphenyl)acrylamide; N-(2-((6-(2-((2,6-dichloro-3,5-dimethoxyphenyl)amino)pyridin-3-yl)pyrimidin-4-yl)amino)-3-methylphenyl)propionamide; or (E)-N-(2-((6-(2-((2,6-dichloro-3,5-dimethoxyphenyl)amino)pyridin-3-yl)pyrimidin-4-yl)amino)-3-methylphenyl)-4-(methyl(prop-2-yn-1-yl)amino)but-2-enamide. In one aspect, the compound inhibits multiple fibroblast growth factor receptors (FGFRs). In another aspect, the compound inhibits just FGFR4.

In another embodiment, the invention provides a method for treating cancer in a subject including administering a compound of Formula (I), as provided above, or an optically pure stereoisomer or pharmaceutically acceptable salt thereof to the subject, thereby treating cancer. In one aspect, the compound is at least one of compounds 1-4 as provided above. In certain aspects, the cancer is breast, lung, bladder, prostate, ovarian, endometrial, rhabdomyosarcoma, liver or gastric. In one aspect, the compound inhibits an FGFR. In another aspect, the compound inhibits FGFR4. In certain aspects, the compound targets amino acid residue 484 of SEQ ID NO: 52, amino acid residue 512 of SEQ ID NO: 56, or amino acid residue 552 of SEQ ID NO: 50 or 54. In an additional aspect, the method further includes administering a chemotherapeutic agent. In various aspects, the compound is administered prior to, simultaneously with or following the administration of the chemotherapeutic agent.

In a further embodiment, the invention provides a pharmaceutical composition comprising a compound of Formula (I), as provided above, and a pharmaceutically acceptable carrier. In one aspect, the compound is a least one compound of compounds 1-4, as provided above.

In another embodiment, the invention provides a method of inhibiting a kinase activity including contacting a cell with a compound of Formula (I), as provided above, thereby inhibiting the kinase activity. In one aspect, the compound is at least one of compounds 1-4, as provided above. In an additional aspect, the kinase is ALK, EGFR, EPH-B3, FAK, FGFR1, FGFR2, FGFR3, FGFR4, KIT, MEK1, MET, PDGFR-ALPHA, PDGFR-BETA, RET, ROS and TYRO 3. In other aspects, the kinase is FGFR1, FGFR2, FGFR3 and/or FGFR4. In another aspect, the kinase is FGFR4. In various aspects, the cell is a cancer cell. In certain aspects, the cancer cell is a breast, lung, bladder, prostate, ovarian, endometrial, rhabdomyosarcoma, liver or gastric cancer cell.

BRIEF DESCRIPTION OF THE DRAWINGS

FIGS. 1A-1B are schematic representations of FGFR kinases. FIG. 1A. Schematic representation of the selective inhibition of FGFRs by electrophilic inhibitors by covalently targeting a thiol group (SH) in the cysteine residue. FIG. 1B. Partial sequence alignment of FGFR kinases within the subdomain V highlighting the unique cysteine residue that FGFR4 contains near the ATP-binding site.

FIGS. 2A-2B are chemical structures of FGFR inhibitors. FIG. 2A. Compound 1 is a pan-inhibitor of FGFR. FIG. 2B. Compounds 2 and 4 are covalent inhibitors of FGFR4—electrophiles or warheads are circled.

FIG. 3 is the general structure of FGFR4 inhibitors.

DETAILED DESCRIPTION OF THE INVENTION

The present invention is based on the seminal discovery of novel pyridinylpyrimidine-based compounds that are potent pan-FGFR and FGFR4 specific inhibitors. Further, the inhibitors can be used as targeted therapies to treat cancer.

Before the present compositions and methods are described, it is to be understood that this invention is not limited to particular compositions, methods, and experimental conditions described, as such compositions, methods, and conditions may vary. It is also to be understood that the terminology used herein is for purposes of describing particular embodiments only, and is not intended to be limiting, since the scope of the present invention will be limited only in the appended claims.

As used in this specification and the appended claims, the singular forms "a", "an", and "the" include plural references unless the context clearly dictates otherwise. Thus, for example, references to "the method" includes one or more methods, and/or steps of the type described herein which will become apparent to those persons skilled in the art upon reading this disclosure and so forth.

All publications, patents, and patent applications mentioned in this specification are herein incorporated by reference to the same extent as if each individual publication, patent, or patent application was specifically and individually indicated to be incorporated by reference.

Unless defined otherwise, all technical and scientific terms used herein have the same meaning as commonly understood by one of ordinary skill in the art to which this invention belongs. Although any methods and materials similar or equivalent to those described herein can be used in the practice or testing of the invention, it will be understood that modifications and variations are encompassed within the spirit and scope of the instant disclosure. The preferred methods and materials are now described.

The present invention is generally directed to small molecule inhibitors of fibroblast growth factor receptors (FGFRs). Table 1 shows the structure of Formula (I). Table 2 shows the structure of compounds 1-4.

TABLE 1

| General structure | |
|---|---|
| Formula (I) | 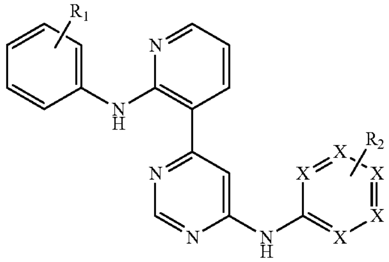 |

TABLE 2

| Compounds structures | | | |
|---|---|---|---|
| 1 | 2 | 3 | 4 |
| 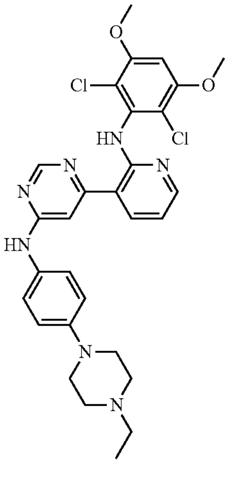 [SMILES: CCN1CCN(c2ccc(Nc3cc(-c4cccnc4Nc4c(Cl)c(OC)cc(OC)c4Cl)ncn3)cc2)CC1] R | 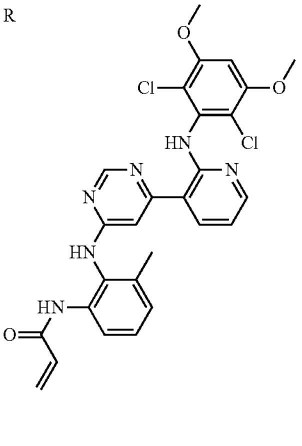 | 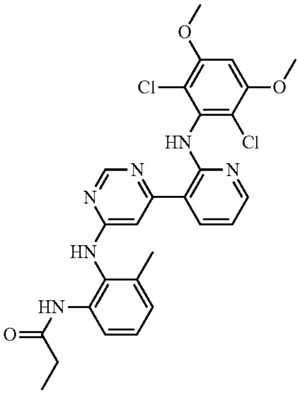 | 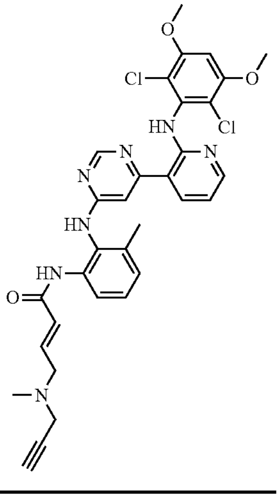 |

In one embodiment, the present invention provides a compound of Formula (I), as provided in Table 1, or an optically pure stereoisomer or pharmaceutically acceptable salt thereof, wherein X is CH or N, R1 is hydrogen, halogen, or methoxy, and n is 0-4; and R2 is hydrogen, methyl, amino, or propargyloxy, and n is 1-2.

As used herein, the term "Alkyl" refers to a straight or branched, saturated, aliphatic radical having the number of carbon atoms indicated. Alkyl can include any number of carbons, such as C1-2, C1-3, C1-4, C1-5, C1-6, C1-7, C1-8, C1-9, C1-10, C2-3, C2-4, C2-5, C2-6, C3-4, C3-5, C3-6, C4-5, C4-6 and C5-6. For example, C1-6 alkyl includes, but is not limited to, methyl, ethyl, propyl, isopropyl, butyl, isobutyl, sec-butyl, tert-butyl, pentyl, isopentyl, hexyl, etc. Alkyl can also refer to alkyl groups having up to 20 carbons atoms, such as, but not limited to heptyl, octyl, nonyl, decyl, etc. Alkyl groups can be substituted or unsubstituted.

As used herein, the term "Alkoxy" refers to an alkyl group having an oxygen atom that connects the alkyl group to the point of attachment: alkyl-O—. As for alkyl group, alkoxy groups can have any suitable number of carbon atoms, such as C1-6. Alkoxy groups include, for example, methoxy, ethoxy, propoxy, iso-propoxy, butoxy, 2-butoxy, iso-butoxy, sec-butoxy, tert-butoxy, pentoxy, hexoxy, etc. The alkoxy groups can be further substituted with a variety of substituents described within. Alkoxy groups can be substituted or unsubstituted.

As used herein, the term "Halogen" refers to fluorine, chlorine, bromine and iodine.

As used herein, the term "Haloalkyl" refers to alkyl, as defined above, where some or all of the hydrogen atoms are replaced with halogen atoms. As for alkyl group, haloalkyl groups can have any suitable number of carbon atoms, such as C1-6. For example, haloalkyl includes trifluoromethyl, flouromethyl, etc. In some instances, the term "perfluoro" can be used to define a compound or radical where all the hydrogens are replaced with fluorine. For example, perfluoromethane refers to 1,1,1-trifluoromethyl.

As used herein, the term "Haloalkoxy" refers to an alkoxy group where some or all of the hydrogen atoms are substituted with halogen atoms. As for an alkyl group, haloalkoxy groups can have any suitable number of carbon atoms, such as C1-6. The alkoxy groups can be substituted with 1, 2, 3, or more halogens. When all the hydrogens are replaced with a halogen, for example by fluorine, the compounds are per-substituted, for example, perfluorinated. Haloalkoxy includes, but is not limited to, trifluoromethoxy, 2,2,2,-trifluoroethoxy, perfluoroethoxy, etc.

As used herein, the term "Heteroalkyl" refers to an alkyl group of any suitable length and having from 1 to 3 heteroatoms such as N, O and S. Additional heteroatoms can also be useful, including, but not limited to, B, Al, Si and P. The heteroatoms can also be oxidized, such as, but not limited to, —S(O)— and —S(O)2-. For example, heteroalkyl can include ethers, thioethers and alkyl-amines. The heteroatom portion of the heteroalkyl can replace a hydrogen of the alkyl group to form a hydroxy, thio or amino group. Alternatively, the heteroatom portion can be the connecting atom, or be inserted between two carbon atoms.

As used herein, the term "Cycloalkyl" refers to a saturated or partially unsaturated, monocyclic, fused bicyclic or bridged polycyclic ring assembly containing from 3 to 12 ring atoms, or the number of atoms indicated. Cycloalkyl can include any number of carbons, such as C3-6, C4-6, C5-6, C3-8, C4-8, C5-8, C6-8, C3-9, C3-10, C3-11, and C3-12. Saturated monocyclic cycloalkyl rings include, for example, cyclopropyl, cyclobutyl, cyclopentyl, cyclohexyl, and cyclooctyl. Saturated bicyclic and polycyclic cycloalkyl rings include, for example, norbornane, [2.2.2] bicyclooctane, decahydronaphthalene and adamantane. Cycloalkyl groups can also be partially unsaturated, having one or more double or triple bonds in the ring. Representative cycloalkyl groups that are partially unsaturated include, but are not limited to, cyclobutene, cyclopentene, cyclohexene, cyclohexadiene (1,3- and 1,4-isomers), cycloheptene, cycloheptadiene, cyclooctene, cyclooctadiene (1,3-, 1,4- and 1,5-isomers), norbornene, and norbornadiene. When cycloalkyl is a saturated monocyclic C3-8 cycloalkyl, exemplary groups include, but are not limited to cyclopropyl, cyclobutyl, cyclopentyl, cyclohexyl, cycloheptyl and cyclooctyl. When cycloalkyl is a saturated monocyclic C3-6 cycloalkyl, exemplary groups include, but are not limited to cyclopropyl, cyclobutyl, cyclopentyl, and cyclohexyl. Cycloalkyl groups can be substituted or unsubstituted.

As used herein, the term "Cycloalkylene" refers to a cycloalkyl group, as defined above, linking at least two other groups, i.e., a divalent hydrocarbon radical. The two moieties linked to the cycloalkylene can be linked to the same atom or different atoms of the cycloalkylene. Representative cycloalkylene groups include, but are not limited to, cyclopropylene, cyclobutylene, cyclopentylene, cyclohexylene, and cyclooctylene. Cycloalkylene groups can be substituted or unsubstituted.

As used herein, the term "Heterocycloalkyl" refers to a saturated ring system having from 3 to 12 ring members and from 1 to 4 heteroatoms of N, O and S. Additional heteroatoms can also be useful, including, but not limited to, B, Al, Si and P. The heteroatoms can also be oxidized, such as, but not limited to, —S(O)— and —S(O)2-. Heterocycloalkyl groups can include any number of ring atoms, such as, 3 to 6, 4 to 6, 5 to 6, 3 to 8, 4 to 8, 5 to 8, 6 to 8, 3 to 9, 3 to 10, 3 to 11, or 3 to 12 ring members. Any suitable number of heteroatoms can be included in the heterocycloalkyl groups, such as 1, 2, 3, or 4, or 1 to 2, 1 to 3, 1 to 4, 2 to 3, 2 to 4, or 3 to 4. The heterocycloalkyl group can include groups such as aziridine, azetidine, pyrrolidine, piperidine, azepane, azocane, quinuclidine, pyrazolidine, imidazolidine, piperazine (1,2-, 1,3- and 1,4-isomers), oxirane, oxetane, tetrahydrofuran, oxane (tetrahydropyran), oxepane, thiirane, thietane, thiolane (tetrahydrothiophene), thiane (tetrahydrothiopyran), oxazolidine, isoxalidine, thiazolidine, isothiazolidine, dioxolane, dithiolane, morpholine, thiomorpholine, dioxane, or dithiane. The heterocycloalkyl groups can also be fused to aromatic or non-aromatic ring systems to form members including, but not limited to, indoline. Heterocycloalkyl groups can be unsubstituted or substituted. For example, heterocycloalkyl groups can be substituted with C1-6 alkyl or oxo (═O), among many others.

The heterocycloalkyl groups can be linked via any position on the ring. For example, aziridine can be 1- or 2-aziridine, azetidine can be 1- or 2-azetidine, pyrrolidine can be 1-, 2- or 3-pyrrolidine, piperidine can be 1-, 2-, 3- or 4-piperidine, pyrazolidine can be 1-, 2-, 3-, or 4-pyrazolidine, imidazolidine can be 1-, 2-, 3- or 4-imidazolidine, piperazine can be 1-, 2-, 3- or 4-piperazine, tetrahydrofuran can be 1- or 2-tetrahydrofuran, oxazolidine can be 2-, 3-, 4- or 5-oxazolidine, isoxazolidine can be 2-, 3-, 4- or 5-isoxazolidine, thiazolidine can be 2-, 3-, 4- or 5-thiazolidine, isothiazolidine can be 2-, 3-, 4- or 5-isothiazolidine, and morpholine can be 2-, 3- or 4-morpholine.

When heterocycloalkyl includes 3 to 8 ring members and 1 to 3 heteroatoms, representative members include, but are not limited to, pyrrolidine, piperidine, tetrahydrofuran, oxane, tetrahydrothiophene, thiane, pyrazolidine, imidazolidine, piperazine, oxazolidine, isoxzoalidine, thiazolidine, isothiazolidine, morpholine, thiomorpholine, dioxane and dithiane. Heterocycloalkyl can also form a ring having 5 to 6 ring members and 1 to 2 heteroatoms, with representative members including, but not limited to, pyrrolidine, piperidine, tetrahydrofuran, tetrahydrothiophene, pyrazolidine, imidazolidine, piperazine, oxazolidine, isoxazolidine, thiazolidine, isothiazolidine, and morpholine.

As used herein, the term "Aryl" refers to an aromatic ring system having any suitable number of ring atoms and any suitable number of rings. Aryl groups can include any suitable number of ring atoms, such as, 6, 7, 8, 9, 10, 11, 12, 13, 14, 15 or 16 ring atoms, as well as from 6 to 10, 6 to 12, or 6 to 14 ring members. Aryl groups can be monocyclic, fused to form bicyclic or tricyclic groups, or linked by a bond to form a biaryl group. Representative aryl groups include phenyl, naphthyl and biphenyl. Other aryl groups include benzyl, having a methylene linking group. Some aryl groups have from 6 to 12 ring members, such as phenyl, naphthyl or biphenyl. Other aryl groups have from 6 to 10 ring members, such as phenyl or naphthyl. Some other aryl groups have 6 ring members, such as phenyl. Aryl groups can be substituted or unsubstituted.

As used herein, the term "Salt" refers to acid or base salts of the compounds used in the methods of the present invention. Illustrative examples of pharmaceutically acceptable salts are mineral acid (hydrochloric acid, hydrobromic acid, phosphoric acid, and the like) salts, organic acid (acetic acid, propionic acid, glutamic acid, citric acid and the like) salts, quaternary ammonium (methyl iodide, ethyl iodide, and the like) salts. It is understood that the pharmaceutically acceptable salts are non-toxic. Additional information on suitable pharmaceutically acceptable salts can be found in Remington's Pharmaceutical Sciences, 17th ed., Mack Publishing Company, Easton, Pa., 1985, which is incorporated herein by reference.

Pharmaceutically acceptable salts of the acidic compounds of the present invention are salts formed with bases, namely cationic salts such as alkali and alkaline earth metal salts, such as sodium, lithium, potassium, calcium, magnesium, as well as ammonium salts, such as ammonium, trimethyl-ammonium, diethylammonium, and tris-(hydroxymethyl)-methyl-ammonium salts.

Similarly acid addition salts, such as of mineral acids, organic carboxylic and organic sulfonic acids, e.g., hydrochloric acid, methanesulfonic acid, maleic acid, are also possible provided a basic group, such as pyridyl, constitutes part of the structure.

The neutral forms of the compounds may be regenerated by contacting the salt with a base or acid and isolating the parent compound in the conventional manner. The parent form of the compound differs from the various salt forms in certain physical properties, such as solubility in polar solvents, but otherwise the salts are equivalent to the parent form of the compound for the purposes of the present invention.

Certain compounds of the present invention possess asymmetric carbon atoms (optical centers) or double bonds; the racemates, diastereomers, geometric isomers and individual isomers are all intended to be encompassed within the scope of the present invention.

As used herein, the term "Hydrate" refers to a compound that is complexed to at least one water molecule. The compounds of the present invention can be complexed with from 1 to 10 water molecules.

In certain aspects, the compound is at least one of compounds 1-4 as shown in Table 2, or an optically pure stereoisomer or a pharmaceutically acceptable salt thereof. In an additional aspect, the compound is 6-(2-((2,6-dichloro-3,5-dimethoxyphenyl)amino)pyridin-3-yl)-N-(4-(4-ethylpiperazin-1-yl)phenyl)pyrimidin-4-amine; N-(2-((6-(2-((2,6-dichloro-3,5-dimethoxyphenyl)amino)pyridin-3-yl)pyrimidin-4-yl)amino)-3-methylphenyl)acrylamide; N-(2-((6-(2-((2,6-dichloro-3,5-dimethoxyphenyl)amino)pyridin-3-yl)pyrimidin-4-yl)amino)-3-methylphenyl)propionamide; or (E)-N-(2-((6-(2-((2,6-dichloro-3,5-dimethoxyphenyl)amino)pyridin-3-yl)pyrimidin-4-yl)amino)-3-methylphenyl)-4-(methyl(prop-2-yn-1-yl)amino)but-2-enamide. In one aspect, the compound inhibits a fibroblast growth factor receptor (FGFR). In another aspect, the compound inhibits FGFR4.

Fibroblast growth factor receptors (FGFRs) are highly conserved receptors consisting of extracellular ligand-binding domain, a transmembrane segment, and a cytoplasmic tyrosine kinase domain. The human FRFR family includes four members, FGFR1, FGFR2, FGFR3, and FGFR4, which can be bound by 18 different ligands called fibroblast growth factors (FGFs). Each receptor is composed of an extracellular domain, consisting of three immunoglobulin-like domain (IgI IgII, and IgIII) and an acid box, the IgII and IgIII domains constituting the FGF ligand-binding site; a transmembrane domain; and a tyrosine kinase cytoplasmic domain. FGFRs also contain hinge region (subdomain V), located near the ATP-binding site (SEQ ID NOs 57-60). FGFRs encoding mRNA are subjected to alternative splicing, giving rise to several protein-coding splice variants or isoforms (SEQ ID NOs: 1; 3; 5; 7; 9; 11; 13; 15; 17; 19; 21; 23; 25; 27; 29; 31; 33; 35; 37; 39; 41; 43; 45; 47; 49; 51; 53; and 55). As shown in Table 3, the human FGFR1 gene encodes 9 protein coding splice variants (SEQ ID Nos: 2; 4; 6; 8; 10; 12; 14; 16; and 18), the human FGFR2 gene encodes 11 protein coding splice variants (SEQ ID Nos: 20; 22; 24; 26; 28; 30; 32; 34; 36; 38; and 40), the human FGFR3 gene encodes four protein coding splice variants (SEQ ID Nos: 42; 44; 46; and 48), and the human FGFR4 gene encodes four protein coding splice variants (SEQ ID Nos: 50; 52; 54; and 56).

There are 18 members in the FGF family of ligands (FGF1-FGF10 and FGF16-FGF23). The binding of a ligand to the extracellular domain of a FGFR leads to receptor dimerization resulting in the activation of the tyrosine-kinase domain by auto-phosphorylation. Subsequently, an activated FGFR phosphorylates cytoplasmic substrates, such as FGFR substrate 2 (FRS2) and phosphlypase Cγ (PLCγ) triggering downstream signaling cascades. Activated FRS2 promotes the RAS-mitogen-activated protein kinase (MAPK) or the phosphoinositide 3-kinase (PI3K)-AKT pathways that regulate cell proliferation, differentiation and survival. On the other hand, the activation of PLCγ lead to calcium release and regulates events that mediate cell motility.

Deregulation of FGFR signaling has been linked to oncogenesis through several mechanisms including activating mutations, gene amplification or changes in post-transcriptional processing, and translocation, leading to constitutive activation of the receptor.

Specifically, FGFR4 amplification and activating mutations have been described in patients with rhabdomyosarcoma, and FGFR4 overexpression have been linked to prostate, colon, breast and liver cancers. FGFR4 differs from the other FGFRs by the presence of a cysteine in the hinge region, which is unique within the FGFR family and rare among other kinases. Depending on the isoform, the cysteine is located at different positions: Cys484 of SEQ ID NO:

52, Cys512 of SEQ ID NO: 56, or Cys552 of SEQ ID NO: 50 or 54. This unique cysteine can be targeted for the design of FGFR4 specific inhibitors exhibiting very good specificity.

As used herein, the term "FGFR inhibitor" or "FGFRi" refers to any compound capable of inhibiting the enzymatic of FGFR, including its own auto-phosphorylation and the kinase activity. Such inhibitors efficiently inhibit FGFRs, and are said to "inhibit", "decrease", or "reduce" the biological activity of FGFRs. The FGFR inhibitors of the invention can be "pan-inhibitor" and present a broad efficiency at inhibiting one or more of FGFR1-FGFR4, or present a specific efficiency at inhibiting only one FGFR, FGFR4 for example.

The efficiency of a compound can be referred to by its IC50 value. The "IC50" is the half-maximal inhibitory concentration (IC50) of a compound. As used herein, the IC50 of a FGFRi refers to the concentration of inhibitor which is sufficient to induce the inhibition of the enzymatic activity of FGFR halfway between the baseline and maximum after a specified exposure time. The IC50 value of the present invention specifically refers to the concentration of FGFR inhibitor which is sufficient to induce the inhibition of one or more FGFRs, i.e. FGFR1, FGFR2, FGFR3 and/or FGFR4.

In another embodiment, the invention provides a method for treating cancer in a subject including administering a compound of Formula (I), as provided in Table 1, wherein X is CH or N, R1 is hydrogen, halogen, or methoxy, and n is 0-4; and R2 is hydrogen, methyl, amino, or propargyloxy, and n is 1-2, or an optically pure stereoisomer or pharmaceutically acceptable salt thereof to the subject, thereby treating cancer. In one aspect, the compound is at least one of compounds 1-4, as shown in Table 2, or an optically pure stereoisomer or a pharmaceutically acceptable salt thereof. In one aspect, the compound inhibits an FGFR. In another aspect, the compound inhibits FGFR4. In certain aspects, the compound targets amino acid residue 484 of SEQ ID NO: 52, amino acid residue 512 of SEQ ID NO: 56, or amino acid residue 552 of SEQ ID NO: 50 or 54.

The term "treatment" is used interchangeably herein with the term "therapeutic method" and refers to both 1) therapeutic treatments or measures that cure, slow down, lessen symptoms of, and/or halt progression of a diagnosed pathologic conditions, disease or disorder, and 2) and prophylactic/preventative measures. Those in need of treatment may include individuals already having a particular medical disease or disorder as well as those who may ultimately acquire the disorder (i.e., those needing preventive measures).

The term "subject" as used herein refers to any individual or patient to which the subject methods are performed. Generally the subject is human, although as will be appreciated by those in the art, the subject may be an animal.

The terms "therapeutically effective amount", "effective dose", "therapeutically effective dose", "effective amount," or the like refer to the amount of a subject compound that will elicit the biological or medical response in a tissue, system, animal or human that is being sought by administering said compound. Generally, the response is either amelioration of symptoms in a patient or a desired biological outcome. Such amount should be sufficient to inhibit FGFR enzymatic activity.

The terms "administration of" and or "administering" should be understood to mean providing a pharmaceutical composition in a therapeutically effective amount to the subject in need of treatment. Administration routes can be enteral, topical or parenteral. As such, administration routes include but are not limited to intracutaneous, subcutaneous, intravenous, intraperitoneal, intraarterial, intrathecal, intracapsular, intraorbital, intracardiac, intradermal, transdermal, transtracheal, subcuticular, intraarticulare, subcapsular, subarachnoid, intraspinal and intrasternal, oral, sublingual buccal, rectal, vaginal, nasal ocular administrations, as well infusion, inhalation, and nebulization.

The term "cancer" refers to a group diseases characterized by abnormal and uncontrolled cell proliferation starting at one site (primary site) with the potential to invade and to spread to others sites (secondary sites, metastases) which differentiate cancer (malignant tumor) from benign tumor. Virtually all the organs can be affected, leading to more than 100 types of cancer that can affect humans. Cancers can result from many causes including genetic predisposition, viral infection, exposure to ionizing radiation, exposure environmental pollutant, tobacco and or alcohol use, obesity, poor diet, lack of physical activity or any combination thereof.

Exemplary cancers described by the national cancer institute include: Acute Lymphoblastic Leukemia, Adult; Acute Lymphoblastic Leukemia, Childhood; Acute Myeloid Leukemia, Adult; Adrenocortical Carcinoma; Adrenocortical Carcinoma, Childhood; AIDS-Related Lymphoma; AIDS-Related Malignancies; Anal Cancer; Astrocytoma, Childhood Cerebellar; Astrocytoma, Childhood Cerebral; Bile Duct Cancer, Extrahepatic; Bladder Cancer; Bladder Cancer, Childhood; Bone Cancer, Osteosarcoma/Malignant Fibrous Histiocytoma; Brain Stem Glioma, Childhood; Brain Tumor, Adult; Brain Tumor, Brain Stem Glioma, Childhood; Brain Tumor, Cerebellar Astrocytoma, Childhood; Brain Tumor, Cerebral Astrocytoma/Malignant Glioma, Childhood; Brain Tumor, Ependymoma, Childhood; Brain Tumor, Medulloblastoma, Childhood; Brain Tumor, Supratentorial Primitive Neuroectodermal Tumors, Childhood; Brain Tumor, Visual Pathway and Hypothalamic Glioma, Childhood; Brain Tumor, Childhood (Other); Breast Cancer; Breast Cancer and Pregnancy; Breast Cancer, Childhood; Breast Cancer, Male; Bronchial Adenomas/Carcinoids, Childhood: Carcinoid Tumor, Childhood; Carcinoid Tumor, Gastrointestinal; Carcinoma, Adrenocortical; Carcinoma, Islet Cell; Carcinoma of Unknown Primary; Central Nervous System Lymphoma, Primary; Cerebellar Astrocytoma, Childhood; Cerebral Astrocytoma/Malignant Glioma, Childhood; Cervical Cancer; Childhood Cancers; Chronic Lymphocytic Leukemia; Chronic Myelogenous Leukemia; Chronic Myeloproliferative Disorders; Clear Cell Sarcoma of Tendon Sheaths; Colon Cancer; Colorectal Cancer, Childhood; Cutaneous T-Cell Lymphoma; Endometrial Cancer; Ependymoma, Childhood; Epithelial Cancer, Ovarian; Esophageal Cancer; Esophageal Cancer, Childhood; Ewing's Family of Tumors; Extracranial Germ Cell Tumor, Childhood; Extragonadal Germ Cell Tumor; Extrahepatic Bile Duct Cancer; Eye Cancer, Intraocular Melanoma; Eye Cancer, Retinoblastoma; Gallbladder Cancer; Gastric (Stomach) Cancer; Gastric (Stomach) Cancer, Childhood; Gastrointestinal Carcinoid Tumor; Germ Cell Tumor, Extracranial, Childhood; Germ Cell Tumor, Extragonadal; Germ Cell Tumor, Ovarian; Gestational Trophoblastic Tumor; Glioma. Childhood Brain Stem; Glioma. Childhood Visual Pathway and Hypothalamic; Hairy Cell Leukemia; Head and Neck Cancer; Hepatocellular (Liver) Cancer, Adult (Primary); Hepatocellular (Liver) Cancer, Childhood (Primary); Hodgkin's Lymphoma, Adult; Hodgkin's Lymphoma, Childhood; Hodgkin's Lymphoma During Pregnancy; Hypopharyngeal Cancer; Hypothalamic and Visual Pathway Glioma, Childhood; Intraocular Melanoma; Islet Cell Carcinoma (Endocrine Pancreas); Kaposi's Sarcoma; Kidney Cancer; Laryngeal Cancer; Laryngeal Cancer, Childhood; Leukemia, Acute Lymphoblastic, Adult; Leukemia, Acute Lymphoblastic, Childhood; Leukemia, Acute Myeloid, Adult; Leukemia, Acute Myeloid, Childhood; Leukemia, Chronic Lymphocytic; Leukemia, Chronic Myelogenous; Leukemia, Hairy Cell; Lip and Oral Cavity Cancer; Liver Cancer, Adult (Primary); Liver Cancer, Childhood (Primary); Lung Cancer, Non-Small Cell; Lung Cancer, Small Cell; Lymphoblastic Leukemia, Adult Acute; Lymphoblastic Leukemia, Childhood Acute; Lymphocytic Leukemia, Chronic; Lymphoma, AIDS-Related; Lymphoma, Central Nervous System (Primary); Lymphoma, Cutaneous T-Cell; Lymphoma, Hodgkin's, Adult; Lymphoma, Hodgkin's; Childhood; Lymphoma, Hodgkin's During Pregnancy; Lymphoma, Non-Hodgkin's, Adult; Lymphoma, Non-Hodgkin's, Childhood; Lymphoma, Non-Hodgkin's During Pregnancy; Lymphoma, Primary Central Nervous System; Macroglobulinemia, Waldenstrom's; Male Breast Cancer; Malignant Mesothelioma, Adult; Malignant Mesothelioma, Childhood; Malignant Thymoma; Medulloblastoma, Childhood; Melanoma; Melanoma, Intraocular; Merkel Cell Carcinoma; Mesothelioma, Malignant; Metastatic Squamous Neck Cancer with Occult Primary; Multiple Endocrine Neoplasia Syndrome, Childhood; Multiple Myeloma/Plasma Cell Neoplasm; Mycosis Fungoides; Myelodysplasia Syndromes; Myelogenous Leukemia, Chronic; Myeloid Leukemia, Childhood Acute; Myeloma, Multiple; Myeloproliferative Disorders, Chronic; Nasal Cavity and Paranasal Sinus Cancer; Nasopharyngeal Cancer; Nasopharyngeal Cancer, Childhood; Neuroblastoma; Non-Hodgkin's Lymphoma, Adult; Non-Hodgkin's Lymphoma, Childhood; Non-Hodgkin's Lymphoma During Pregnancy; Non-Small Cell Lung Cancer; Oral Cancer, Childhood; Oral Cavity and Lip Cancer; Oropharyngeal Cancer; Osteosarcoma/Malignant Fibrous Histiocytoma of Bone; Ovarian Cancer, Childhood; Ovarian Epithelial Cancer; Ovarian Germ Cell Tumor; Ovarian Low Malignant Potential Tumor; Pancreatic Cancer; Pancreatic Cancer, Childhood', Pancreatic Cancer, Islet Cell; Paranasal Sinus and Nasal Cavity Cancer; Parathyroid Cancer; Penile Cancer; Pheochromocytoma; Pineal and Supratentorial Primitive Neuroectodermal Tumors, Childhood; Pituitary Tumor; Plasma Cell Neoplasm/Multiple Myeloma; Pleuropulmonary Blastoma; Pregnancy and Breast Cancer; Pregnancy and Hodgkin's Lymphoma; Pregnancy and Non-Hodgkin's Lymphoma; Primary Central Nervous System Lymphoma; Primary Liver Cancer, Adult; Primary Liver Cancer, Childhood; Prostate Cancer; Rectal Cancer; Renal Cell (Kidney) Cancer; Renal Cell Cancer, Childhood; Renal Pelvis and Ureter, Transitional Cell Cancer; Retinoblastoma; Rhabdomyosarcoma, Childhood; Salivary Gland Cancer; Salivary Gland' Cancer, Childhood; Sarcoma, Ewing's Family of Tumors; Sarcoma, Kaposi's; Sarcoma (OsteosarcomaVMalignant Fibrous Histiocytoma of Bone; Sarcoma, Rhabdomyosarcoma, Childhood; Sarcoma, Soft Tissue, Adult; Sarcoma, Soft Tissue, Childhood; Sezary Syndrome; Skin Cancer; Skin Cancer, Childhood; Skin Cancer (Melanoma); Skin Carcinoma, Merkel Cell; Small Cell Lung Cancer; Small Intestine Cancer; Soft Tissue Sarcoma, Adult; Soft Tissue Sarcoma, Childhood; Squamous Neck Cancer with Occult Primary, Metastatic; Stomach (Gastric) Cancer; Stomach (Gastric) Cancer, Childhood; Supratentorial Primitive Neuroectodermal Tumors, Childhood; T-Cell Lymphoma, Cutaneous; Testicular Cancer; Thymoma, Childhood; Thymoma, Malignant; Thyroid Cancer; Thyroid Cancer, Childhood; Transitional Cell Cancer of the Renal Pelvis and Ureter; Trophoblastic Tumor, Gestational; Unknown Primary Site, Cancer of, Childhood; Unusual Cancers of Childhood; Ureter and Renal Pelvis, Transitional Cell Cancer; Urethral Cancer; Uterine Sarcoma; Vaginal Cancer; Visual Pathway and Hypothalamic Glioma, Childhood; Vulvar Cancer; Waldenstrom's Macro globulinemia; and Wilms' Tumor.

In certain aspects, cancer include Lung cancer, Breast cancer, Colorectal cancer, Prostate cancer, Stomach cancer, Liver cancer, cervical cancer, Esophageal cancer, Bladder cancer, Non-Hodgkin lymphoma, Leukemia, Pancreatic cancer, Kidney cancer, endometrial cancer, Head and neck cancer, Lip cancer, oral cancer, Thyroid cancer, Brain cancer, Ovary cancer, Melanoma, Gallbladder cancer, Laryngeal cancer, Multiple myeloma, Nasopharyngeal cancer, Hodgkin lymphoma, Testis cancer and Kaposi sarcoma.

In certain aspects, the method further includes administering a chemotherapeutic agent. The compounds of the invention can be administered in combination with one or more additional therapeutic agents. The phrases "combination therapy", "combined with" and the like refer to the use of more than one medication or treatment simultaneously to increase the response. The FGFR inhibitor of the present invention might for example be used in combination with other drugs or treatment in use to treat cancer. In various aspect, the compound is administered prior to, simultaneously with or following the administration of the chemotherapeutic agent.

The term "anti-cancer therapy" refers to any therapy or treatment that can be used for the treatment of a cancer. Anti-cancer therapies include, but are not limited to, surgery, radiotherapy, chemotherapy, immune therapy and targeted therapies.

Examples of chemotherapeutic agents or anti-cancer agents include, but are not limited to, Actinomycin, Azacitidine, Azathioprine, Bleomycin, Bortezomib, Carboplatin, Capecitabine, Cisplatin, Chlorambucil, Cyclophosphamide, Cytarabine, Daunorubicin, Docetaxel, Doxifluridine, Doxorubicin, Epirubicin, Epothilone, Etoposide, Fiuorouracil, Gemcitabine, Hydroxyurea, Idarubicin, Imatinib, Irinotecan, Mechlorethamine, Mercaptopurine, Methotrexate, Mitoxantrone, Oxaliplatin, Paclitaxel, Pemetrexed, Teniposide, Tioguanine, Topotecan, Valrubicin, Vinblastine, Vincristine, Vindesine, Vinorelbine, panitumamab, Erbitux (cetuximab), matuzumab, IMC-IIF 8, TheraCIM hR3, denosumab, Avastin (bevacizumab), Humira (adalimumab), Herceptin (trastuzumab), Remicade (infliximab), rituximab, Synagis (palivizumab), Mylotarg (gemtuzumab oxogamicin), Raptiva (efalizumab), Tysabri (natalizumab), Zenapax (daclix-imab), NeutroSpec (Technetium (99mTc) fanolesomab), tocilizumab, ProstaScint (Indium-Ill labeled Capromab Pendetide), Bexxar (tositumomab), Zevalin (ibritumomab tiuxetan (IDEC-Y2B8) conjugated to yttrium 90), Xolair (omalizumab), MabThera (Rituximab), ReoPro (abciximab), MabCampath (alemtuzumab), Simulect (basiliximab), LeukoScan (sulesomab), CEA-Scan (arcitumomab), Verluma (nofetumomab), Panorex (Edrecolomab), alemtuzumab, CDP 870, natalizumab Gilotrif (afatinib), Lynparza (olaparib), Perj eta (pertuzumab), Otdivo (nivolumab), Bosulif (bosutinib), Cabometyx (cabozantinib), Ogivri (trastuzumab-dkst), Sutent (sunitinib malate), Adcetris (brentuximab vedotin), Alecensa (alectinib), Calquence (acalabrutinib), Yescarta (ciloleucel), Verzenio (abemaciclib), Keytruda (pembrolizumab), Aliqopa (copanlisib), Nerlynx (neratinib), Imfinzi (durvalumab), Darzalex (daratumumab), Tecentriq (atezolizumab), and Tarceva (erlotinib). Examples of immunotherapeutic agent include, but are not limited to, interleukins (Il-2, Il-7, Il-12), cytokines (Interferons, G-CSF, imiquimod), chemokines (CCL3, CCl26, CXCL7), immunomodulatory imide drugs (thalidomide and its analogues).

In an additional embodiment, the invention provides a pharmaceutical composition comprising a compound of Formula (I), as shown in Table 1, wherein X is CH or N, R1 is hydrogen, halogen, or methoxy, and n is 0-4; and R2 is hydrogen, methyl, amino, or propargyloxy, and n is 1-2, or an optically pure stereoisomer or pharmaceutically acceptable salt and a pharmaceutically acceptable carrier. In one aspect, the compound is at least on of compounds 1-4, as shown in Table 2, or an optically pure stereoisomer or a pharmaceutically acceptable salt thereof.

By "pharmaceutically acceptable" it is meant the carrier, diluent or excipient must be compatible with the other ingredients of the formulation and not deleterious to the recipient thereof. For example, the carrier, diluent, or excipient or composition thereof may be administered to a subject along with a FGFR inhibitor of the invention without causing any undesirable biological effects or interacting in an undesirable manner with the FGFR inhibitor of the pharmaceutical composition in which it is contained.

In a further embodiment, the invention provides a method of inhibiting a kinase activity including contacting a cell with a compound of Formula (I), as shown in Table 1, wherein X is CH or N, R1 is hydrogen, halogen, or methoxy, and n is 0-4; and R2 is hydrogen, methyl, amino, or propargyloxy, and n is 1-2, or an optically pure stereoisomer or pharmaceutically acceptable salt, thereby inhibit the kinase activity. In one aspects, the compound is at least one of compounds 1-4, as shown in Table 2, or an optically pure stereoisomer or a pharmaceutically acceptable salt thereof. In one aspect, the kinase is selected from the group consisting of ALK, EGFR, EPH-B3, FAK, FGFR1, FGFR2, FGFR3, FGFR4, KIT, MEK1, MET, PDGFR-ALPHA, PDGFR-BETA, RET, ROS and TYRO 3. In certain aspects, the kinase is FGFR1, FGFR2, FGFR3 and/or FGFR4. In another aspect, the kinase is FGFR4. In various aspects, the cell is a cancer cell. In many aspects, the cancer cell is a breast, lung, bladder, prostate, ovarian, endometrial, rhabdomyosarcoma, liver or gastric cancer cell.

Presented below are examples discussing the design and evaluation of efficacy of new pyridinylpyrimidine-based FGFR inhibitors, contemplated for the discussed applications. The following examples are provided to further illustrate the embodiments of the present invention, but are not intended to limit the scope of the invention. While they are typical of those that might be used, other procedures, methodologies, or techniques known to those skilled in the art may alternatively be used

EXAMPLES

Example 1

Design of Pyridinylpyrimidine-Based FGFR Inhibitors

Using structure-based design, two types of pyridinylpyrimidine-based inhibitors of FGFRs have been discovered: pan-FGFR inhibitors and FGFR4 specific ones. Specifically, docking was performed to evaluate the binding mode and affinity of candidate inhibitors to FGFRs.

As illustrated in FIG. 1B, the FGFR4 kinase contains a cysteine (Cys552) located near the ATP-binding site, in the hinge region of the receptor, which is unique within the FGFR family and rare among other kinases. Covalent inhibitors of FGFR4 kinase afford potent and selective inhibition of FGFRs by covalently targeting a thiol group (SH) in the cysteine residue (FIG. 1A).

A structure-based design method allowed the discovery of novel pan-FGFR inhibitors, such as compound 1, shown in FIG. 2A and of FGFR4 specific inhibitors, such as compounds 2, 3, and 4, represented in FIG. 2B.

Example 2

General Structure of New FGFR4 Specific Inhibitors

Using the structure-based design described above, a general structure of other FGFR4 specific inhibitor was established. Other specific inhibitors of FGFR4 can be synthesized and their general structure is presented in FIG. 3.

In the general structure above, X is CH or N. In the phenyl ring at the top, each $R^1$ substituent is hydrogen, halogen, or methoxy, and n is 0-4. In the second phenyl ring, each $R^2$ substituent is hydrogen, methyl, amino, or propargyloxy, and n is 1-2. This phenyl contains a warhead, usually attached to a N atom, which is an electrophilic moiety that can form a covalent bond with a nucleophile. Examples of the warhead include, but are not limited to, haloacetamides and acrylamides.

Example 3

Evaluation of the In Vitro Efficacy of FGFR Inhibitors

The efficacy of the compounds to inhibit the kinase activity of FGFRs was measured by the determination of the IC50 value.

Two of the compounds: compound 1 and compound 2 were tested in vitro against the correspondent FGFR (FGFR2 for the pan inhibitor, compound 1, and FGFR4 for the covalent inhibitor, compound 2). The results are listed in Table 4 expressed as $IC_{50}$ values (the concentration of compound at which 50% of the enzyme activity is inhibited).

TABLE 4

In vitro inhibitory assays of compounds 1 and 2.

| | |
|---|---|
| Compound 1 | FGFR2 |
| $IC_{50}$ | 6.0 nM |
| Compound 2 | FGFR4 |
| $IC_{50}$ | 0.13 nM |

In order to assess the spectrum of efficacy of the compounds to inhibit enzymatic activity, the inhibition of 15 divergent kinases by compounds 1 and 2 was evaluated. As illustrated in Table 5, compound 1, the pan-FGFR inhibitor, shown significant inhibition of all members of the FGFR family, plus some inhibitory activity against a few other kinases. Compound 2 demonstrated high selectivity and potency against FGFR4 (only selected data are shown for both inhibitors).

TABLE 5

Inhibition of 15 divergent protein kinases by compounds 1 and 2.

| Kinase | Compound 1* | Compound 2* |
|---|---|---|
| ALK | 0 | 0 |
| EGFR | 2 | 1 |

TABLE 5-continued

Inhibition of 15 divergent protein kinases by compounds 1 and 2.

| Kinase | Compound 1* | Compound 2* |
|---|---|---|
| EPH-B3 | 0 | 0 |
| FAK | 1 | −4 |
| FGFR1 | 98 | 1 |
| FGFR2 | 98 | −1 |
| FGFR3 | 76 | −5 |
| FGFR4 | 53 | 98 |
| KIT | 62 | 2 |
| MEK1 | 0 | 1 |
| MET | 2 | −6 |
| PDGFR-ALPHA | 9 | 2 |
| PDGFR-BETA | 5 | 0 |
| RET | 37 | −2 |
| ROS | 3 | 1 |
| TYRO3 | 2 | 0 |

*Percent Inhibition. Compounds 1 and 2 were both used at 100 nM in the assay.

Given the oncogenic roles of FGFRs in various cancers, these novel pyridinylpyrimidine-based FGFR inhibitors, or their derivatives, have strong potential to be used as cancer targeted therapies.

TABLE 3

FGFR sequences

| | | |
|---|---|---|
| SEQ ID | FGFR1 | AGATGCAGGGGCGCAAACGCCAAAGGAGACCAGGCTGTAGGAAGAGAAGGGCAGAGC |
| NO: 1 | isoform 1 | GCCGGACAGCTCGGCCCGCTCCCCGTCCTTTGGGGCCGCGGCTGGGGAACTACAAGG |
| | Nucleic acid | CCCAGCAGGCAGCTGCAGGGGGCGGAGGCGGAGGAGGGACCAGCGCGGGTGGGAGTG |
| | sequence | AGAGAGCGAGCCCTCGCGCCCCGCCGGCGCATAGCGCTCGGAGCGCTCTTGCGGCCA |
| | | CAGGCGCGGCGTCCTCGGCGGCGGGCGGCAGCTAGCGGGAGCCGGGACGCCGGTGCA |
| | | GCCGCAGCGCGCGGAGGAACCCGGGTGTGCCGGGAGCTGGGCGGCCACGTCCGGACG |
| | | GGACCGAGACCCCTCGTAGCGCATTGCGGCGACCTCGCCTTCCCCGGCCGCGAGCGC |
| | | GCCGCTGCTTGAAAAGCCGCGGAACCCAAGGACTTTTCTCCGGTCCGAGCTCGGGGC |
| | | GCCCCGCAGGGCGCACGGTACCCGTGCTGCAGTCGGGCACGCCGCGGCGCCGGGGCC |
| | | TCCGCAGGGCGATGGAGCCCGGTCTGCAAGGAAAGTGAGGCGCCGCCGCTGCGTTCT |
| | | GGAGGAGGGGGGCACAAGGTCTGGAGACCCCGGGTGGCGGACGGGAGCCCTCCCCCC |
| | | GCCCCGCCTCCGGGGCACCAGCTCCGGCTCCATTGTTCCCGCCCGGGCTGGAGGCGC |
| | | CGAGCACCGAGCGCCGCCGGGAGTCGAGCGCCGGCCGCGGAGCTCTTGCGACCCCGC |
| | | CAGGACCCGAACAGAGCCCGGGGGCGGCGGGCCGGAGCCGGGGACGCGGGCACACGC |
| | | CCGCTCGCACAAGCCACGGCGGACTCTCCCGAGGCGGAACCTCCACGCCGAGCGAGG |
| | | GTCAGTTTGAAAAGGAGGATCGAGCTCACTGTGGAGTATCCATGGAGATGTGGAGCC |
| | | TTGTCACCAACCTCTAACTGCAGAACTGGGATGTGGAGCTGGAAGTGCCTCCTCTTC |
| | | TGGGCTGTGCTGGTCACAGCCACACTCTGCACCGCTAGGCCGTCCCCGACCTTGCCT |
| | | GAACAAGCCCAGCCCTGGGGAGCCCCTGTGGAAGTGGAGTCCTTCCTGGTCCACCCC |
| | | GGTGACCTGCTGCAGCTTCGCTGTCGGCTGCGGGACGATGTGCAGAGCATCAACTGG |
| | | CTGCGGGACGGGGTGCAGCTGGCGGAAAGCAACCGCACCCGCATCACAGGGGAGGAG |
| | | GTGGAGGTGCAGGACTCCGTGCCCGCAGACTCCGGCCTCTATGCTTGCGTAACCAGC |
| | | AGCCCCTCGGGCAGTGACACCACCTACTTCTCCGTCAATGTTTCAGATGCTCTCCCC |
| | | TCCTCGGAGGATGATGATGATGATGATGACTCCTCTTCAGAGGAGAAAGAAACAGAT |
| | | AACACCAAACCAAACCGTATGCCCGTAGCTCCATATTGGACATCCCCAGAAAAGATG |
| | | GAAAAGAAATTGCATGCAGTGCCGGCTGCCAAGACAGTGAAGTTCAAATGCCCTTCC |
| | | AGTGGGACCCCAAACCCCACACTGCGCTGGTTGAAAAATGGCAAAGAATTCAAACCT |
| | | GACCACAGAATTGGAGGCTACAAGGTCCGTTATGCCACCTGGAGCATCATAATGGAC |
| | | TCTGTGGTGCCCTCTGACAAGGGCAACTACACCTGCATTGTGGAGAATGAGTACGGC |
| | | AGCATCAACCACACATACCAGCTGGATGTCGTGGAGCGGTCCCCTCACCGGCCCATC |
| | | CTGCAAGCAGGGTTGCCCGCCAACAAAACAGTGGCCCTGGGTAGCAACGTGGAGTTC |
| | | ATGTGTAAGGTGTACAGTGACCCGCAGCCGCACATCCAGTGGCTAAAGCACATCGAG |
| | | GTGAATGGGAGCAAGATTGGCCCAGACAACCTGCCTTATGTCCAGATCTTGAAGACT |
| | | GCTGGAGTTAATACCACCGACAAAGAGATGGAGGTGCTTCACTTAAGAAATGTCTCC |
| | | TTTGAGGACGCAGGGGAGTATACGTGCTTGGCGGGTAACTCTATCGGACTCTCCCAT |
| | | CACTCTGCATGGTTGACCGTTCTGGAAGCCCTGGAAGAGAGGCCGGCAGTGATGACC |
| | | TCGCCCCTGTACCTGGAGATCATCATCTATTGCACAGGGGCCTTCCTCATCTCCTGC |
| | | ATGGTGGGGTCGGTCATCGTCTACAAGATGAAGAGTGGTACCAAGAAGAGTGACTTC |
| | | CACAGCCAGATGGCTGTGCACAAGCTGGCCAAGAGCATCCCTCTGCGCAGACAGGTA |
| | | ACAGTGTCTGCTGACTCCAGTGCATCCATGAACTCTGGGGTTCTTCTGGTTCGGCCA |
| | | TCACGGCTCTCCTCCAGTGGGACTCCCATGCTAGCAGGGGTCTCTGAGTATGAGCTT |
| | | CCCGAAGACCCTCGCTGGGAGCTGCCTCGGGACAGACTGGTCTTAGGCAAACCCCTG |
| | | GGAGAGGGCTGCTTTGGGCAGGTGGTGTTGGCAGAGGCTATCGGGCTGGACAAGGAC |
| | | AAACCCAACCGTGTGACCAAAGTGGCTGTGAAGATGTTGAAGTCGGACGCAACAGAG |
| | | AAAGACTTGTCAGACCTGATCTCAGAAATGGAGATGATGAAGATGATCGGGAAGCAT |
| | | AAGAATATCATCAACCTGCTGGGGGCCTGCACGCAGGATGGTCCCTTGTATGTCATC |
| | | GTGGAGTATGCCTCCAAGGGCAACCTGCGGGAGTACCTGCAGGCCCGGAGGCCCCCA |
| | | GGGCTGGAATACTGCTACAACCCCAGCCACAACCCAGAGGAGCAGCTCTCCTCCAAG |
| | | GACCTGGTGTCCTGCGCCTACCAGGTGGCCCGAGGCATGGAGTATCTGGCCTCCAAG |
| | | AAGTGCATACACCGAGACCTGGCAGCCAGGAATGTCCTGGTGACAGAGGACAATGTG |
| | | ATGAAGATAGCAGACTTTGGCCTCGCACGGGACATTCACCACATCGACTACTATAAA |
| | | AAGACAACCAACGGCCGACTGCCTGTGAAGTGGATGGCACCCGAGGCATTATTTGAC |
| | | CGGATCTACACCCACCAGAGTGATGTGTGGTCTTTCGGGGTGCTCCTGTGGGAGATC |
| | | TTCACTCTGGGCGGCTCCCCATACCCCGGTGTGCCTGTGGAGGAACTTTTCAAGCTG |
| | | CTGAAGGAGGGTCACCGCATGGACAAGCCCAGTAACTGCACCAACGAGCTGTACATG |
| | | ATGATGCGGGACTGCTGGCATGCAGTGCCCTCACAGAGACCCACCTTCAAGCAGCTG |
| | | GTGGAAGACCTGGACCGCATCGTGGCCTTGACCTCCAACCAGGAGTACCTGGACCTG |
| | | TCCATGCCCCTGGACCAGTACTCCCCCAGCTTTCCCGACACCCGGAGCTCTACGTGC |
| | | TCCTCAGGGGAGGATTCCGTCTTCTCTCATGAGCCGCTGCCCGAGGAGCCCTGCCTG |

TABLE 3-continued

| FGFR sequences | | |
|---|---|---|
| | | CCCCGACACCCAGCCCAGCTTGCCAATGGCGGACTCAAACGCCGCTGACTGCCACCC<br>ACACGCCCTCCCCAGACTCCACCGTCAGCTGTAACCCTCACCCACAGCCCCTGCTGG<br>GCCCACCACCTGTCCGTCCCTGTCCCCTTTCCTGCTGGCAGGAGCCGGCTGCCTACC<br>AGGGGCCTTCCTGTGTGGCCTGCCTTCACCCCACTCAGCTCACCTCTCCCTCCACCT<br>CCTCTCCACCTGCTGGTGAGAGGTGCAAAGAGGCAGATCTTTGCTGCCAGCCACTTC<br>ATCCCCTCCCAGATGTTGGACCAACACCCCTCCCTGCCACCAGGCACTGCCTGGAGG<br>GCAGGGAGTGGGAGCCAATGAACAGGCATGCAAGTGAGAGCTTCCTGAGCTTTCTCC<br>TGTCGGTTTGGTCTGTTTTGCCTTCACCCATAAGCCCCTCGCACTCTGGTGGCAGGT<br>GCCTTGTCCTCAGGGCTACAGCAGTAGGGAGGTCAGTGCTTCGTGCCTCGATTGAAG<br>GTGACCTCTGCCCCAGATAGGTGGTGCCAGTGGCTTATTAATTCCGATACTAGTTTG<br>CTTTGCTGACCAAATGCCTGGTACCAGAGGATGGTGAGGCGAAGGCCAGGTTGGGGG<br>CAGTGTTGTGGCCCTGGGGCCCAGCCCCAAACTGGGGGCTCTGTATATAGCTATGAA<br>GAAAACACAAAGTGTATAAATCTGAGTATATATTTACATGTCTTTTTAAAAGGGTCG<br>TTACCAGAGATTTACCCATCGGGTAAGATGCTCCTGGTGGCTGGGAGGCATCAGTTG<br>CTATATATTAAAAACAAAAAAGAAAAAAAAGGAAAATGTTTTTAAAAAGGTCATATA<br>TTTTTTGCTACTTTTGCTGTTTTATTTTTTTAAATTATGTTCTAAACCTATTTTCAG<br>TTTAGGTCCCTCAATAAAAATTGCTGCTGCTTCATTTATCTATGGGCTGTATGAAAA<br>GGGTGGGAATGTCCACTGGAAAGAAGGGACACCCACGGGCCCTGGGGCTAGGTCTGT<br>CCCGAGGGCACCGCATGCTCCCGGCGCAGGTTCCTTGTAACCTCTTCTTCCTAGGTC<br>CTGCACCCAGACCTCACGACGCACCTCCTGCCTCTCCGCTGCTTTTGGAAAGTCAGA<br>AAAAGAAGATGTCTGCTTCGAGGGCAGGAACCCCATCCATGCAGTAGAGGCGCTGGG<br>CAGAGAGTCAAGGCCCAGCAGCCATCGACCATGGATGGTTTCCTCCAAGGAAACCGG<br>TGGGGTTGGGCTGGGGAGGGGGCACCTACCTAGGAATAGCCACGGGGTAGAGCTACA<br>GTGATTAAGAGGAAAGCAAGGGCGCGGTTGCTCACGCCTGTAATCCCAGCACTTTGG<br>GACACCGAGGTGGGCAGATCACTTCAGGTCAGGAGTTTGAGACCAGCCTGGCCAACT<br>TAGTGAAACCCCATCTCTACTAAAAATGCAAAAATTATCCAGGCATGGTGGCACACG<br>CCTGTAATCCCAGCTCCACAGGAGGCTGAGGCAGAATCCCTTGAAGCTGGGAGGCGG<br>AGGTTGCAGTGAGCCGAGATTGCGCCATTGCACTCCAGCCTGGGCAACAGAGAAAAC<br>AAAAAGGAAAACAAATGATGAAGGTCTGCAGAAACTGAAACCCAGACATGTGTCTGC<br>CCCCTCTATGTGGGCATGGTTTTGCCAGTGCTTCTAAGTGCAGGAGAACATGTCACC<br>TGAGGCTAGTTTTGCATTCAGGTCCCTGGCTTCGTTTCTTGTTGGTATGCCTCCCCA<br>GATCGTCCTTCCTGTATCCATGTGACCAGACTGTATTTGTTGGGACTGTCGCAGATC<br>TTGGCTTCTTACAGTTCTTCCTGTCCAAACTCCATCCTGTCCCTCAGGAACGGGGGG<br>AAAATTCTCCGAATGTTTTTGGTTTTTTGGCTGCTTGGAATTTACTTCTGCCACCTG<br>CTGGTCATCACTGTCCTCACTAAGTGGATTCTGGCTCCCCCGTACCTCATGGCTCAA<br>ACTACCACTCCTCAGTCGCTATATTAAAGCTTATATTTTGCTGGATTACTGCTAAAT<br>ACAAAAGAAAGTTCAATATGTTTTCATTTCTGTAGGGAAAATGGGATTGCTGCTTTA<br>AATTTCTGAGCTAGGGATTTTTTGGCAGCTGCAGTGTTGGCGACTATTGTAAAATTC<br>TCTTTGTTTCTCTCTGTAAATAGCACCTGCTAACATTACAATTTGTATTTATGTTTA<br>AAGAAGGCATCATTTGGTGAACAGAACTAGGAAATGAATTTTTAGCTCTTAAAAGCA<br>TTTGCTTTGAGACCGCACAGGAGTGTCTTTCCTTGTAAAACAGTGATGATAATTTCT<br>GCCTTGGCCCTACCTTGAAGCAATGTTGTGTGAAGGGATGAAGAATCTAAAAGTCTT<br>CATAAGTCCTTGGGAGAGGTGCTAGAAAAATATAAGGCACTATCATAATTACAGTGA<br>TGTCCTTGCTGTTACTACTCAAATCACCCACAAATTTCCCCAAAGACTGCGCTAGCT<br>GTCAAATAAAAGACAGTGAAATTGACCTG |
| SEQ ID NO: 2 | FGFR1 isoform 1 Amino acid sequence | MWSWKCLLFWAVLVTATLCTARPSPTLPEQAQPWGAPVEVESFLVHPGDLLQLRCRL<br>RDDVQSINWLRDGVQLAESNRTRITGEEVEVQDSVPADSGLYACVTSSPSGSDTTYF<br>SVNVSDALPSSEDDDDDDDSSSEEKETDNTKPNRMPVAPYWTSPEKMEKKLHAVPAA<br>KTVKFKCPSSGTPNPTLRWLKNGKEFKPDHRIGGYKVRYATWSIIMDSVVPSDKGNY<br>TCIVENEYGSINHTYQLDVVERSPHRPILQAGLPANKTVALGSNVEFMCKVYSDPQP<br>HIQWLKHIEVNGSKIGPDNLPYVQILKTAGVNTTDKEMEVLHLRNVSFEDAGEYTCL<br>AGNSIGLSHHSAWLTVLEALEERPAVMTSPLYLEIIIYCTGAFLISCMVGSVIVYKM<br>LAGVSEYELPEDPRWELPRDRLVLGKPLGEGCFGQVVLAEAIGLDKDKPNRVTKVAV<br>KMLKSDATEKDLSDLISEMEMMKMIGKHKNIINLLGACTQDGPLYV**IVEYASKGNLR**<br>EYLQARRPPGLEYCYNPSHNPEEQLSSKDLVSCAYQVARGMEYLASKKCIHRDLAAR<br>NVLVTEDNVMKIADFGLARDIHHIDYYKKTTNGRLPVKWMAPEALFDRIYTHQSDVW<br>SFGVLLWEIFTLGGSPYPGVPVEELFKLLKEGHRMDKPSNCTNELYMMMRDCWHAVP<br>SQRPTFKQLVEDLDRIVALTSNQEYLDLSMPLDQYSPSFPDTRSSTCSSGEDSVFSH<br>EPLPEEPCLPRHPAQLANGGLKRR |
| SEQ ID NO: 3 | FGFR1 isoform 2 Nucleic acid sequence | GCCGGCGCATAGCGCTCGGAGCGCTCTTGCGGCCACAGGCGCGGCGTCCTCGGCGGC<br>GGGCGGCAGCTAGCGGGAGCCGGGACGCCGGTGCAGCCGCAGCGCGCGGAGGAACCC<br>GGGTGTGCCGGGAGCTGGGCGGCCACGTCCGGACGGGACCGAGACCCCTCGTAGCGC<br>ATTGCGGCGACCTCGCCTTCCCCGGCCGCGAGCGCGCCGCTGCTTGAAAAGCCGCGG<br>AACCCAAGGACTTTTCTCCGGTCCGAGCTCGGGGCGCCCCGCAGGGCGCACGGTACC<br>CGTGCTGCAGTCGGGCACGCCGCGGCGCCGGGGCCTCCGCAGGGCGATGGAGCCCGG<br>TCTGCAAGGAAAGTGAGGCGCCGCCGCTGCGTTCTGGAGGAGGGGGGCACAAGGTCT<br>GGAGACCCCGGGTGGCGGACGGGAGCCCTCCCCCCGCCCCGCCTCCGGGGCACCAGC<br>TCCGGCTCCATTGTTCCCGCCCGGGCTGGAGGCGCCGAGCACCGAGCGCCGCCGGGA<br>GTCGAGCGCCGGCCGCGGAGCTCTTGCGACCCCGCCAGGACCCGAACAGAGCCCGGG<br>GGCGGCGGGCCGGAGCCGGGGACGCGGGCACACGCCCGCTCGCACAAGCCACGGCGG<br>ACTCTCCCGAGGCGGAACCTCCACGCCGAGCGAGGGTCAGTTTGAAAAGGAGGATCG<br>AGCTCACTGTGGAGTATCCATGGAGATGTGGAGCCTTGTCACCAACCTCTAACTGCA<br>GAACTGGGATGTGGAGCTGGAAGTGCCTCCTCTTCTGGGCTGTGCTGGTCACAGCCA<br>CACTCTGCACCGCTAGGCCGTCCCCGACCTTGCCTGAACAAGCCCAGCCCTGGGGAG<br>CCCCTGTGGAAGTGGAGTCCTTCCTGGTCCACCCCGGTGACCTGCTGCAGCTTCGCT<br>GTCGGCTGCGGGACGATGTGCAGAGCATCAACTGGCTGCGGGACGGGGTGCAGCTGG |

TABLE 3-continued

| FGFR sequences |
|---|
| CGGAAAGCAACCGCACCCGCATCACAGGGGAGGAGGTGGAGGTGCAGGACTCCGTGC<br>CCGCAGACTCCGGCCTCTATGCTTGCGTAACCAGCAGCCCCTCGGGCAGTGACACCA<br>CCTACTTCTCCGTCAATGTTTCAGATGCTCTCCCCTCCTCGGAGGATGATGATGATG<br>ATGATGACTCCTCTTCAGAGGAGAAAGAAACAGATAACACCAAACCAAACCCCGTAG<br>CTCCATATTGGACATCCCCAGAAAAGATGGAAAAGAAATTGCATGCAGTGCCGGCTG<br>CCAAGACAGTGAAGTTCAAATGCCCTTCCAGTGGGACCCCAAACCCCACACTGCGCT<br>GGTTGAAAAATGGCAAAGAATTCAAACCTGACCACAGAATTGGAGGCTACAAGGTCC<br>GTTATGCCACCTGGAGCATCATAATGGACTCTGTGGTGCCCTCTGACAAGGGCAACT<br>ACACCTGCATTGTGGAGAATGAGTACGGCAGCATCAACCACACATACCAGCTGGATG<br>TCGTGGAGCGGTCCCCTCACCGGCCCATCCTGCAAGCAGGGTTGCCCGCCAACAAAA<br>CAGTGGCCCTGGGTAGCAACGTGGAGTTCATGTGTAAGGTGTACAGTGACCCGCAGC<br>CGCACATCCAGTGGCTAAAGCACATCGAGGTGAATGGGAGCAAGATTGGCCCAGACA<br>ACCTGCCTTATGTCCAGATCTTGAAGACTGCTGGAGTTAATACCACCGACAAAGAGA<br>TGGAGGTGCTTCACTTAAGAAATGTCTCCTTTGAGGACGCAGGGGAGTATACGTGCT<br>TGGCGGGTAACTCTATCGGACTCTCCCATCACTCTGCATGGTTGACCGTTCTGGAAG<br>CCCTGGAAGAGAGGCCGGCAGTGATGACCTCGCCCCTGTACCTGGAGATCATCATCT<br>ATTGCACAGGGGCCTTCCTCATCTCCTGCATGGTGGGGTCGGTCATCGTCTACAAGA<br>TGAAGAGTGGTACCAAGAAGAGTGACTTCCACAGCCAGATGGCTGTGCACAAGCTGG<br>CCAAGAGCATCCCTCTGCGCAGACAGGTAACAGTGTCTGCTGACTCCAGTGCATCCA<br>TGAACTCTGGGGTTCTTCTGGTTCGGCCATCACGGCTCTCCTCCAGTGGGACTCCCA<br>TGCTAGCAGGGGTCTCTGAGTATGAGCTTCCCGAAGACCCTCGCTGGGAGCTGCCTC<br>GGGACAGACTGGTCTTAGGCAAACCCCTGGGAGAGGGCTGCTTTGGGCAGGTGGTGT<br>TGGCAGAGGCTATCGGGCTGGACAAGGACAAACCCAACCGTGTGACCAAAGTGGCTG<br>TGAAGATGTTGAAGTCGGACGCAACAGAGAAAGACTTGTCAGACCTGATCTCAGAAA<br>TGGAGATGATGAAGATGATCGGGAAGCATAAGAATATCATCAACCTGCTGGGGGCCT<br>GCACGCAGGATGGTCCCTTGTATGTCATCGTGGAGTATGCCTCCAAGGGCAACCTGC<br>GGGAGTACCTGCAGGCCCGGAGGCCCCCAGGGCTGGAATACTGCTACAACCCCAGCC<br>ACAACCCAGAGGAGCAGCTCTCCTCCAAGGACCTGGTGTCCTGCGCCTACCAGGTGG<br>CCCGAGGCATGGAGTATCTGGCCTCCAAGAAGTGCATACACCGAGACCTGGCAGCCA<br>GGAATGTCCTGGTGACAGAGGACAATGTGATGAAGATAGCAGACTTTGGCCTCGCAC<br>GGGACATTCACCACATCGACTACTATAAAAAGACAACCAACGGCCGACTGCCTGTGA<br>AGTGGATGGCACCCGAGGCATTATTTGACCGGATCTACACCCACCAGAGTGATGTGT<br>GGTCTTTCGGGGTGCTCCTGTGGGAGATCTTCACTCTGGGCGGCTCCCCATACCCCG<br>GTGTGCCTGTGGAGGAACTTTTCAAGCTGCTGAAGGAGGGTCACCGCATGGACAAGC<br>CCAGTAACTGCACCAACGAGCTGTACATGATGATGCGGGACTGCTGGCATGCAGTGC<br>CCTCACAGAGACCCACCTTCAAGCAGCTGGTGGAAGACCTGGACCGCATCGTGGCCT<br>TGACCTCCAACCAGGAGTACCTGGACCTGTCCATGCCCCTGGACCAGTACTCCCCCA<br>GCTTTCCCGACACCCGGAGCTCTACGTGCTCCTCAGGGGAGGATTCCGTCTTCTCTC<br>ATGAGCCGCTGCCCGAGGAGCCCTGCCTGCCCCGACACCCAGCCCAGCTTGCCAATG<br>GCGGACTCAAACGCCGCTGACTGCCACCCACACGCCCTCCCCAGACTCCACCGTCAG<br>CTGTAACCCTCACCCACAGCCCCTGCTGGGCCCACCACCTGTCCGTCCCTGTCCCCT<br>TTCCTGCTGGCAGGAGCCGGCTGCCTACCAGGGGCCTTCCTGTGTGGCCTGCCTTCA<br>CCCCACTCAGCTCACCTCTCCCTCCACCTCCTCTCCACCTGCTGGTGAGAGGTGCAA<br>AGAGGCAGATCTTTGCTGCCAGCCACTTCATCCCCTCCCAGATGTTGGACCAACACC<br>CCTCCCTGCCACCAGGCACTGCCTGGAGGGCAGGGAGTGGGAGCCAATGAACAGGCA<br>TGCAAGTGAGAGCTTCCTGAGCTTTCTCCTGTCGGTTTGGTCTGTTTTGCCTTCACC<br>CATAAGCCCCTCGCACTCTGGTGGCAGGTGCCTTGTCCTCAGGGCTACAGCAGTAGG<br>GAGGTCAGTGCTTCGTGCCTCGATTGAAGGTGACCTCTGCCCCAGATAGGTGGTGCC<br>AGTGGCTTATTAATTCCGATACTAGTTTGCTTTGCTGACCAAATGCCTGGTACCAGA<br>GGATGGTGAGGCGAAGGCCAGGTTGGGGGCAGTGTTGTGGCCCTGGGGCCCAGCCCC<br>AAACTGGGGGCTCTGTATATAGCTATGAAGAAAACACAAAGTGTATAAATCTGAGTA<br>TATATTTACATGTCTTTTTAAAAGGGTCGTTACCAGAGATTTACCCATCGGGTAAGA<br>TGCTCCTGGTGGCTGGGAGGCATCAGTTGCTATATATTAAAAACAAAAAAGAAAAAA<br>AAGGAAAATGTTTTTAAAAAGGTCATATATTTTTTGCTACTTTTGCTGTTTTATTTT<br>TTTAAATTATGTTCTAAACCTATTTTCAGTTTAGGTCCCTCAATAAAAATTGCTGCT<br>GCTTCATTTATCTATGGGCTGTATGAAAAGGGTGGGAATGTCCACTGGAAAGAAGGG<br>ACACCCACGGGCCCTGGGGCTAGGTCTGTCCCGAGGGCACCGCATGCTCCCGGCGCA<br>GGTTCCTTGTAACCTCTTCTTCCTAGGTCCTGCACCCAGACCTCACGACGCACCTCC<br>TGCCTCTCCGCTGCTTTTGGAAAGTCAGAAAAAGAAGATGTCTGCTTCGAGGGCAGG<br>AACCCCATCCATGCAGTAGAGGCGCTGGGCAGAGAGTCAAGGCCCAGCAGCCATCGA<br>CCATGGATGGTTTCCTCCAAGGAAACCGGTGGGGTTGGGCTGGGGAGGGGGCACCTA<br>CCTAGGAATAGCCACGGGGTAGAGCTACAGTGATTAAGAGGAAAGCAAGGGCGCGGT<br>TGCTCACGCCTGTAATCCCAGCACTTTGGGACACCGAGGTGGGCAGATCACTTCAGG<br>TCAGGAGTTTGAGACCAGCCTGGCCAACTTAGTGAAACCCCATCTCTACTAAAAATG<br>CAAAAATTATCCAGGCATGGTGGCACACGCCTGTAATCCCAGCTCCACAGGAGGCTG<br>AGGCAGAATCCCTTGAAGCTGGGAGGCGGAGGTTGCAGTGAGCCGAGATTGCGCCAT<br>TGCACTCCAGCCTGGGCAACAGAGAAAACAAAAAGGAAAACAAATGATGAAGGTCTG<br>CAGAAACTGAAACCCAGACATGTGTCTGCCCCCTCTATGTGGGCATGGTTTTGCCAG<br>TGCTTCTAAGTGCAGGAGAACATGTCACCTGAGGCTAGTTTTGCATTCAGGTCCCTG<br>GCTTCGTTTCTTGTTGGTATGCCTCCCCAGATCGTCCTTCCTGTATCCATGTGACCA<br>GACTGTATTTGTTGGGACTGTCGCAGATCTTGGCTTCTTACAGTTCTTCCTGTCCAA<br>ACTCCATCCTGTCCCTCAGGAACGGGGGGAAAATTCTCCGAATGTTTTTGGTTTTTT<br>GGCTGCTTGGAATTTACTTCTGCCACCTGCTGGTCATCACTGTCCTCACTAAGTGGA<br>TTCTGGCTCCCCCGTACCTCATGGCTCAAACTACCACTCCTCAGTCGCTATATTAAA<br>GCTTATATTTTGCTGGATTACTGCTAAATACAAAAGAAAGTTCAATATGTTTTCATT<br>TCTGTAGGGAAAATGGGATTGCTGCTTTAAATTTCTGAGCTAGGGATTTTTTGGCAG<br>CTGCAGTGTTGGCGACTATTGTAAAATTCTCTTTGTTTCTCTCTGTAAATAGCACCT<br>GCTAACATTACAATTTGTATTTATGTTTAAAGAAGGCATCATTTGGTGAACAGAACT |

TABLE 3-continued

| FGFR sequences | | |
|---|---|---|
| | | AGGAAATGAATTTTTAGCTCTTAAAAGCATTTGCTTTGAGACCGCACAGGAGTGTCT<br>TTCCTTGTAAAACAGTGATGATAATTTCTGCCTTGGCCCTACCTTGAAGCAATGTTG<br>TGTGAAGGGATGAAGAATCTAAAAGTCTTCATAAGTCCTTGGGAGAGGTGCTAGAAA<br>AATATAAGGCACTATCATAATTACAGTGATGTCCTTGCTGTTACTACTCAAATCACC<br>CACAAATTTCCCCAAAGACTGCGCTAGCTGTCAAATAAAAGACAGTGAAATTGACCT<br>GA |
| SEQ ID NO: 4 | FGFR 1 isoform 2 Amino acid sequence | MWSWKCLLFWAVLVTATLCTARPSPTLPEQAQPWGAPVEVESFLVHPGDLLQLRCRL<br>RDDVQSINWLRDGVQLAESNRTRITGEEVEVQDSVPADSGLYACVTSSPSGSDTTYF<br>SVNVSDALPSSEDDDDDDDSSSEEKETDNTKPNPVAPYWTSPEKMEKKLHAVPAAKT<br>VKFKCPSSGTPNPTLRWLKNGKEFKPDHRIGGYKVRYATWSIIMDSVVPSDKGNYTC<br>IVENEYGSINHTYQLDVVERSPHRPILQAGLPANKTVALGSNVEFMCKVYSDPQPHI<br>QWLKHIEVNGSKIGPDNLPYVQILKTAGVNTTDKEMEVLHLRNVSFEDAGEYTCLAG<br>NSIGLSHHSAWLTVLEALEERPAVMTSPLYLEIIIYCTGAFLISCMVGSVIVYKMKS<br>GTKKSDFHSQMAVHKLAKSIPLRRQVTVSADSSASMNSGVLLVRPSRLSSSGTPMLA<br>GVSEYELPEDPRWELPRDRLVLGKPLGEGCFGQVVLAEAIGLDKDKPNRVTKVAVKM<br>LKSDATEKDLSDLISEMEMMKMIGKHKNIINLLGACTQDGPLYV**IVEYASKGNLR**EY<br>LQARRPPGLEYCYNPSHNPEEQLSSKDLVSCAYQVARGMEYLASKKCIHRDLAARNV<br>LVTEDNVMKIADFGLARDIHHIDYYKKTTNGRLPVKWMAPEALFDRIYTHQSDVWSF<br>GVLLWEIFTLGGSPYPGVPVEELFKLLKEGHRMDKPSNCTNELYMMMRDCWHAVPSQ<br>RPTFKQLVEDLDRIVALTSNQEYLDLSMPLDQYSPSFPDTRSSTCSSGEDSVFSHEP<br>LPEEPCLPRHPAQLANGGLKRR |
| SEQ ID NO: 5 | FGFR1 isoform 3 Nucleic acid sequence | AGCGCTCTTGCGGCCACAGGCGCGGCGTCCTCGGCGGCGGGCGGCAGCTAGCGGGAG<br>CCGGGACGCCGGTGCAGCCGCAGCGCGCGGAGGAACCCGGGTGTGCCGGGAGCTGGG<br>CGGCCACGTCCGGACGGGACCGAGACCCCTCGTAGCGCATTGCGGCGACCTCGCCTT<br>CCCCGGCCGCGAGCGCGCCGCTGCTTGAAAAGCCGCGGAACCCAAGGACTTTTCTCC<br>GGTCCGAGCTCGGGGCGCCCCGCAGGGCGCACGGTACCCGTGCTGCAGTCGGGCACG<br>CCGCGGCGCCGGGGCCTCCGCAGGGCGATGGAGCCCGGTCTGCAAGGAAAGTGAGGC<br>GCCGCCGCTGCGTTCTGGAGGAGGGGGGCACAAGGTCTGGAGACCCCGGGTGGCGGA<br>CGGGAGCCCTCCCCCCGCCCCGCCTCCGGGGCACCAGCTCCGGCTCCATTGTTCCCG<br>CCCGGGCTGGAGGCGCCGAGCACCGAGCGCCGCCGGGAGTCGAGCGCCGGCCGCGGA<br>GCTCTTGCGACCCCGCCAGGACCCGAACAGAGCCCGGGGGCGGCGGGCCGGAGCCGG<br>GGACGCGGGCACACGCCCGCTCGCACAAGCCACGGCGGACTCTCCCGAGGCGGAACC<br>TCCACGCCGAGCGAGGGTCAGTTTGAAAAGGAGGATCGAGCTCACTGTGGAGTATCC<br>ATGGAGATGTGGAGCCTTGTCACCAACCTCTAACTGCAGAACTGGGATGTGGAGCTG<br>GAAGTGCCTCCTCTTCTGGGCTGTGCTGGTCACAGCCACACTCTGCACCGCTAGGCC<br>GTCCCCGACCTTGCCTGAACAAGCCCAGCCCTGGGGAGCCCCTGTGGAAGTGGAGTC<br>CTTCCTGGTCCACCCCGGTGACCTGCTGCAGCTTCGCTGTCGGCTGCGGGACGATGT<br>GCAGAGCATCAACTGGCTGCGGGACGGGGTGCAGCTGGCGGAAAGCAACCGCACCCG<br>CATCACAGGGGAGGAGGTGGAGGTGCAGGACTCCGTGCCCGCAGACTCCGGCCTCTA<br>TGCTTGCGTAACCAGCAGCCCCTCGGGCAGTGACACCACCTACTTCTCCGTCAATGT<br>TTCAGATGCTCTCCCCTCCTCGGAGGATGATGATGATGATGATGACTCCTCTTCAGA<br>GGAGAAAGAAACAGATAACACCAAACCAAACCGTATGCCCGTAGCTCCATATTGGAC<br>ATCCCCAGAAAAGATGGAAAAGAAATTGCATGCAGTGCCGGCTGCCAAGACAGTGAA<br>GTTCAAATGCCCTTCCAGTGGGACCCCAAACCCCACACTGCGCTGGTTGAAAAATGG<br>CAAAGAATTCAAACCTGACCACAGAATTGGAGGCTACAAGGTCCGTTATGCCACCTG<br>GAGCATCATAATGGACTCTGTGGTGCCCTCTGACAAGGGCAACTACACCTGCATTGT<br>GGAGAATGAGTACGGCAGCATCAACCACACATACCAGCTGGATGTCGTGGAGCGGTC<br>CCCTCACCGGCCCATCCTGCAAGCAGGGTTGCCCGCCAACAAAACAGTGGCCCTGGG<br>TAGCAACGTGGAGTTCATGTGTAAGGTGTACAGTGACCCGCAGCCGCACATCCAGTG<br>GCTAAAGCACATCGAGGTGAATGGGAGCAAGATTGGCCCAGACAACCTGCCTTATGT<br>CCAGATCTTGAAGACTGCTGGAGTTAATACCACCGACAAAGAGATGGAGGTGCTTCA<br>CTTAAGAAATGTCTCCTTTGAGGACGCAGGGGAGTATACGTGCTTGGCGGGTAACTC<br>TATCGGACTCTCCCATCACTCTGCATGGTTGACCGTTCTGGAAGCCCTGGAAGAGAG<br>GCCGGCAGTGATGACCTCGCCCCTGTACCTGGAGATCATCATCTATTGCACAGGGGC<br>CTTCCTCATCTCCTGCATGGTGGGGTCGGTCATCGTCTACAAGATGAAGAGTGGTAC<br>CAAGAAGAGTGACTTCCACAGCCAGATGGCTGTGCACAAGCTGGCCAAGAGCATCCC<br>TCTGCGCAGACAGGTGTCTGCTGACTCCAGTGCATCCATGAACTCTGGGGTTCTTCT<br>GGTTCGGCCATCACGGCTCTCCTCCAGTGGGACTCCCATGCTAGCAGGGGTCTCTGA<br>GTATGAGCTTCCCGAAGACCCTCGCTGGGAGCTGCCTCGGGACAGACTGGTCTTAGG<br>CAAACCCCTGGGAGAGGGCTGCTTTGGGCAGGTGGTGTTGGCAGAGGCTATCGGGCT<br>GGACAAGGACAAACCCAACCGTGTGACCAAAGTGGCTGTGAAGATGTTGAAGTCGGA<br>CGCAACAGAGAAAGACTTGTCAGACCTGATCTCAGAAATGGAGATGATGAAGATGAT<br>CGGGAAGCATAAGAATATCATCAACCTGCTGGGGGCCTGCACGCAGGATGGTCCCTT<br>GTATGTCATCGTGGAGTATGCCTCCAAGGGCAACCTGCGGGAGTACCTGCAGGCCCG<br>GAGGCCCCCAGGGCTGGAATACTGCTACAACCCCAGCCACAACCCAGAGGAGCAGCT<br>CTCCTCCAAGGACCTGGTGTCCTGCGCCTACCAGGTGGCCCGAGGCATGGAGTATCT<br>GGCCTCCAAGAAGTGCATACACCGAGACCTGGCAGCCAGGAATGTCCTGGTGACAGA<br>GGACAATGTGATGAAGATAGCAGACTTTGGCCTCGCACGGGACATTCACCACATCGA<br>CTACTATAAAAAGACAACCAACGGCCGACTGCCTGTGAAGTGGATGGCACCCGAGGC<br>ATTATTTGACCGGATCTACACCCACCAGAGTGATGTGTGGTCTTTCGGGGTGCTCCT<br>GTGGGAGATCTTCACTCTGGGCGGCTCCCCATACCCCGGTGTGCCTGTGGAGGAACT<br>TTTCAAGCTGCTGAAGGAGGGTCACCGCATGGACAAGCCCAGTAACTGCACCAACGA<br>GCTGTACATGATGATGCGGGACTGCTGGCATGCAGTGCCCTCACAGAGACCCACCTT<br>CAAGCAGCTGGTGGAAGACCTGGACCGCATCGTGGCCTTGACCTCCAACCAGGAGTA<br>CCTGGACCTGTCCATGCCCCTGGACCAGTACTCCCCCAGCTTTCCCGACACCCGGAG<br>CTCTACGTGCTCCTCAGGGGAGGATTCCGTCTTCTCTCATGAGCCGCTGCCCGAGGA |

TABLE 3-continued

| FGFR sequences | | |
|---|---|---|
| | | GCCCTGCCTGCCCCGACACCCAGCCCAGCTTGCCAATGGCGGACTCAAACGCCGCTG<br>ACTGCCACCCACACGCCCTCCCCAGACTCCACCGTCAGCTGTAACCCTCACCCACAG<br>CCCCTGCTGGGCCCACCACCTGTCCGTCCCTGTCCCCTTTCCTGCTGGCAGGAGCCG<br>GCTGCCTACCAGGGGCCTTCCTGTGTGGCCTGCCTTCACCCCACTCAGCTCACCTCT<br>CCCTCCACCTCCTCTCCACCTGCTGGTGAGAGGTGCAAAGAGGCAGATCTTTGCTGC<br>CAGCCACTTCATCCCCTCCCAGATGTTGGACCAACACCCCTCCCTGCCACCAGGCAC<br>TGCCTGGAGGGCAGGGAGTGGGAGCCAATGAACAGGCATGCAAGTGAGAGCTTCCTG<br>AGCTTTCTCCTGTCGGTTTGGTCTGTTTTGCCTTCACCCATAAGCCCCTCGCACTCT<br>GGTGGCAGGTGCCTTGTCCTCAGGGCTACAGCAGTAGGGAGGTCAGTGCTTCGTGCC<br>TCGATTGAAGGTGACCTCTGCCCCAGATAGGTGGTGCCAGTGGCTTATTAATTCCGA<br>TACTAGTTTGCTTTGCTGACCAAATGCCTGGTACCAGAGGATGGTGAGGCGAAGGCC<br>AGGTTGGGGGCAGTGTTGTGGCCCTGGGGCCCAGCCCCAAACTGGGGGCTCTGTATA<br>TAGCTATGAAGAAAACACAAAGTGTATAAATCTGAGTATATATTTACATGTCTTTTT<br>AAAAGGGTCGTTACCAGAGATTTACCCATCGGGTAAGATGCTCCTGGTGGCTGGGAG<br>GCATCAGTTGCTATATATTAAAAACAAAAAAGAAAAAAAAGGAAAATGTTTTTAAAA<br>AGGTCATATATTTTTTGCTACTTTTGCTGTTTTATTTTTTTAAATTATGTTCTAAAC<br>CTATTTTCAGTTTAGGTCCCTCAATAAAAATTGCTGCTGCTTCATTTATCTATGGGC<br>TGTATGAAAAGGGTGGGAATGTCCACTGGAAAGAAGGGACACCCACGGGCCCTGGGG<br>CTAGGTCTGTCCCGAGGGCACCGCATGCTCCCGGCGCAGGTTCCTTGTAACCTCTTC<br>TTCCTAGGTCCTGCACCCAGACCTCACGACGCACCTCCTGCCTCTCCGCTGCTTTTG<br>GAAAGTCAGAAAAAGAAGATGTCTGCTTCGAGGGCAGGAACCCCATCCATGCAGTAG<br>AGGCGCTGGGCAGAGAGTCAAGGCCCAGCAGCCATCGACCATGGATGGTTTCCTCCA<br>AGGAAACCGGTGGGGTTGGGCTGGGGAGGGGGCACCTACCTAGGAATAGCCACGGGG<br>TAGAGCTACAGTGATTAAGAGGAAAGCAAGGGCGCGGTTGCTCACGCCTGTAATCCC<br>AGCACTTTGGGACACCGAGGTGGGCAGATCACTTCAGGTCAGGAGTTTGAGACCAGC<br>CTGGCCAACTTAGTGAAACCCCATCTCTACTAAAAATGCAAAAATTATCCAGGCATG<br>GTGGCACACGCCTGTAATCCCAGCTCCACAGGAGGCTGAGGCAGAATCCCTTGAAGC<br>TGGGAGGCGGAGGTTGCAGTGAGCCGAGATTGCGCCATTGCACTCCAGCCTGGGCAA<br>CAGAGAAAACAAAAAGGAAAACAAATGATGAAGGTCTGCAGAAACTGAAACCCAGAC<br>ATGTGTCTGCCCCCTCTATGTGGGCATGGTTTTGCCAGTGCTTCTAAGTGCAGGAGA<br>ACATGTCACCTGAGGCTAGTTTTGCATTCAGGTCCCTGGCTTCGTTTCTTGTTGGTA<br>TGCCTCCCCAGATCGTCCTTCCTGTATCCATGTGACCAGACTGTATTTGTTGGGACT<br>GTCGCAGATCTTGGCTTCTTACAGTTCTTCCTGTCCAAACTCCATCCTGTCCCTCAG<br>GAACGGGGGGAAAATTCTCCGAATGTTTTTGGTTTTTTGGCTGCTTGGAATTTACTT<br>CTGCCACCTGCTGGTCATCACTGTCCTCACTAAGTGGATTCTGGCTCCCCCGTACCT<br>CATGGCTCAAACTACCACTCCTCAGTCGCTATATTAAAGCTTATATTTTGCTGGATT<br>ACTGCTAAATACAAAAGAAAGTTCAATATGTTTTCATTTCTGTAGGGAAAATGGGAT<br>TGCTGCTTTAAATTTCTGAGCTAGGGATTTTTTGGCAGCTGCAGTGTTGGCGACTAT<br>TGTAAAATTCTCTTTGTTTCTCTCTGTAAATAGCACCTGCTAACATTACAATTTGTA<br>TTTATGTTTAAAGAAGGCATCATTTGGTGAACAGAACTAGGAAATGAATTTTTAGCT<br>CTTAAAAGCATTTGCTTTGAGACCGCACAGGAGTGTCTTTCCTTGTAAAACAGTGAT<br>GATAATTTCTGCCTTGGCCCTACCTTGAAGCAATGTTGTGTGAAGGATGAAGAATC<br>TAAAAGTCTTCATAAGTCCTTGGGAGAGGTGCTAGAAAAATATAAGGCACTATCATA<br>ATTA |
| SEQ ID NO: 6 | FGFR1 isoform 3 Amino acid sequence | MWSWKCLLFWAVLVTATLCTARPSPTLPEQAQPWGAPVEVESFLVHPGDLLQLRCRL<br>RDDVQSINWLRDGVQLAESNRTRITGEEVEVQDSVPADSGLYACVTSSPSGSDTTYF<br>SVNVSDALPSSEDDDDDDDSSSEEKETDNTKPNRMPVAPYWTSPEKMEKKLHAVPAA<br>KTVKFKCPSSGTPNPTLRWLKNGKEFKPDHRIGGYKVRYATWSIIMDSVVPSDKGNY<br>TCIVENEYGSINHTYQLDVVERSPHRPILQAGLPANKTVALGSNVEFMCKVYSDPQP<br>HIQWLKHIEVNGSKIGPDNLPYVQILKTAGVNTTDKEMEVLHLRNVSFEDAGEYTCL<br>AGNSIGLSHHSAWLTVLEALEERPAVMTSPLYLEIIIYCTGAFLISCMVGSVIVYKM<br>KSGTKKSDFHSQMAVHKLAKSIPLRRQVSADSSASMNSGVLLVRPSRLSSSGTPMLA<br>GVSEYELPEDPRWELPRDRLVLGKPLGEGCFGQVVLAEAIGLDKDKPNRVTKVAVKM<br>LKSDATEKDLSDLISEMEMMKMIGKHKNIINLLGACTQDGPLYV**IVEYASKGNLR**EY<br>LQARRPPGLEYCYNPSHNPEEQLSSKDLVSCAYQVARGMEYLASKKCIHRDLAARNV<br>LVTEDNVMKIADFGLARDIHHIDYYKKTTNGRLPVKWMAPEALFDRIYTHQSDVWSF<br>GVLLWEIFTLGGSPYPGVPVEELFKLLKEGHRMDKPSNCTNELYMMMRDCWHAVPSQ<br>RPTFKQLVEDLDRIVALTSNQEYLDLSMPLDQYSPSFPDTRSSTCSSGEDSVFSHEP<br>LPEEPCLPRHPAQLANGGLKRR |
| SEQ ID NO: 7 | FGFR1 isoform 4 Nucleic acid sequence | CCCTTTCACCTCCTGGCTCCCTCCCGGGCGATCCGCGCCCCTTGGGTCTCCCCTCCC<br>TTCCCTCCGTCCGCGTCTCCTGCGCCCCTCCCTGCGCTCGTCCCGCCGCTCTTCCC<br>GCCGCCCAACTTTTCCTCCAACTCGCGCTCGGGAGCTGGCGAGGCGGCGGCGGCTCC<br>TCAAAGTGGGAGAGCTTCAAGGTCACGTGGTCCGTCCAGCCCCTGCTATCTCACCAG<br>ACACTGTCCACCCTGTATGTTGGATCAGTACTCCAGTGAGAAGACAGCAGGCACTTT<br>CACCCATGCAGCCCATTCAGTCTTCATAACCACCTGTGATGGAGGCAAGGGTCAGTT<br>TGAAAAGGAGGATCGAGCTCACTGTGGAGTATCCATGGAGATGTGGAGCCTTGTCAC<br>CAACCTCTAACTGCAGAACTGGGATGTGGAGCTGGAAGTGCCTCCTCTTCTGGGCTG<br>TGCTGGTCACAGCCACACTCTGCACCGCTAGGCCGTCCCCGACCTTGCCTGAACAAG<br>CCCAGCCCTGGGGAGCCCCTGTGGAAGTGGAGTCCTTCCTGGTCCACCCCGGTGACC<br>TGCTGCAGCTTCGCTGTCGGCTGCGGGACGATGTGCAGAGCATCAACTGGCTGCGGG<br>ACGGGGTGCAGCTGGCGGAAAGCAACCGCACCCGCATCACAGGGGAGGAGGTGGAGG<br>TGCAGGACTCCGTGCCCGCAGACTCCGGCCTCTATGCTTGCGTAACCAGCAGCCCCT<br>CGGGCAGTGACACCACCTACTTCTCCGTCAATGTTTCAGATGCTCTCCCCTCCTCGG<br>AGGATGATGATGATGATGATGACTCCTCTTCAGAGGAGAAAGAAACAGATAACACCA<br>AACCAAACCCCGTAGCTCCATATTGGACATCCCCAGAAAAGATGGAAAAGAAATTGC<br>ATGCAGTGCCGGCTGCCAAGACAGTGAAGTTCAAATGCCCTTCCAGTGGGACCCCAA |

TABLE 3-continued

| FGFR sequences |
|---|
| ACCCCACACTGCGCTGGTTGAAAAATGGCAAAGAATTCAAACCTGACCACAGAATTG<br>GAGGCTACAAGGTCCGTTATGCCACCTGGAGCATCATAATGGACTCTGTGGTGCCCT<br>CTGACAAGGGCAACTACACCTGCATTGTGGAGAATGAGTACGGCAGCATCAACCACA<br>CATACCAGCTGGATGTCGTGGAGCGGTCCCCTCACCGGCCCATCCTGCAAGCAGGGT<br>TGCCCGCCAACAAAACAGTGGCCCTGGGTAGCAACGTGGAGTTCATGTGTAAGGTGT<br>ACAGTGACCCGCAGCCGCACATCCAGTGGCTAAAGCACATCGAGGTGAATGGGAGCA<br>AGATTGGCCCAGACAACCTGCCTTATGTCCAGATCTTGAAGACTGCTGGAGTTAATA<br>CCACCGACAAAGAGATGGAGGTGCTTCACTTAAGAAATGTCTCCTTTGAGGACGCAG<br>GGGAGTATACGTGCTTGGCGGGTAACTCTATCGGACTCTCCCATCACTCTGCATGGT<br>TGACCGTTCTGGAAGCCCTGGAAGAGAGGCCGGCAGTGATGACCTCGCCCCTGTACC<br>TGGAGATCATCATCTATTGCACAGGGGCCTTCCTCATCTCCTGCATGGTGGGGTCGG<br>TCATCGTCTACAAGATGAAGAGTGGTACCAAGAAGAGTGACTTCCACAGCCAGATGG<br>CTGTGCACAAGCTGGCCAAGAGCATCCCTCTGCGCAGACAGGTAACAGTGTCTGCTG<br>ACTCCAGTGCATCCATGAACTCTGGGGTTCTTCTGGTTCGGCCATCACGGCTCTCCT<br>CCAGTGGGACTCCCATGCTAGCAGGGGTCTCTGAGTATGAGCTTCCCGAAGACCCTC<br>GCTGGGAGCTGCCTCGGGACAGACTGGTCTTAGGCAAACCCCTGGGAGAGGGCTGCT<br>TTGGGCAGGTGGTGTTGGCAGAGGCTATCGGGCTGGACAAGGACAAACCCAACCGTG<br>TGACCAAAGTGGCTGTGAAGATGTTGAAGTCGGACGCAACAGAGAAAGACTTGTCAG<br>ACCTGATCTCAGAAATGGAGATGATGAAGATGATCGGGAAGCATAAGAATATCATCA<br>ACCTGCTGGGGGCCTGCACGCAGGATGGTCCCTTGTATGTCATCGTGGAGTATGCCT<br>CCAAGGGCAACCTGCGGGAGTACCTGCAGGCCCGGAGGCCCCCAGGGCTGGAATACT<br>GCTACAACCCCAGCCACAACCCAGAGGAGCAGCTCTCCTCCAAGGACCTGGTGTCCT<br>GCGCCTACCAGGTGGCCCGAGGCATGGAGTATCTGGCCTCCAAGAAGTGCATACACC<br>GAGACCTGGCAGCCAGGAATGTCCTGGTGACAGAGGACAATGTGATGAAGATAGCAG<br>ACTTTGGCCTCGCACGGGACATTCACCACATCGACTACTATAAAAAGACAACCAACG<br>GCCGACTGCCTGTGAAGTGGATGGCACCCGAGGCATTATTTGACCGGATCTACACCC<br>ACCAGAGTGATGTGTGGTCTTTCGGGGTGCTCCTGTGGGAGATCTTCACTCTGGGCG<br>GCTCCCCATACCCCGGTGTGCCTGTGGAGGAACTTTTCAAGCTGCTGAAGGAGGGTC<br>ACCGCATGGACAAGCCCAGTAACTGCACCAACGAGCTGTACATGATGATGCGGGACT<br>GCTGGCATGCAGTGCCCTCACAGAGACCCACCTTCAAGCAGCTGGTGGAAGACCTGG<br>ACCGCATCGTGGCCTTGACCTCCAACCAGGAGTACCTGGACCTGTCCATGCCCCTGG<br>ACCAGTACTCCCCCAGCTTTCCCGACACCCGGAGCTCTACGTGCTCCTCAGGGGAGG<br>ATTCCGTCTTCTCTCATGAGCCGCTGCCCGAGGAGCCCTGCCTGCCCCGACACCCAG<br>CCCAGCTTGCCAATGGCGGACTCAAACGCCGCTGACTGCCACCCACACGCCCTCCCC<br>AGACTCCACCGTCAGCTGTAACCCTCACCCACAGCCCCTGCTGGGCCCACCACCTGT<br>CCGTCCCTGTCCCCTTTCCTGCTGGCAGGAGCCGGCTGCCTACCAGGGGCCTTCCTG<br>TGTGGCCTGCCTTCACCCCACTCAGCTCACCTCTCCCTCCACCTCCTCTCCACCTGC<br>TGGTGAGAGGTGCAAAGAGGCAGATCTTTGCTGCCAGCCACTTCATCCCCTCCCAGA<br>TGTTGGACCAACACCCCTCCCTGCCACCAGGCACTGCCTGGAGGGCAGGGAGTGGGA<br>GCCAATGAACAGGCATGCAAGTGAGAGCTTCCTGAGCTTTCTCCTGTCGGTTTGGTC<br>TGTTTTGCCTTCACCCATAAGCCCCTCGCACTCTGGTGGCAGGTGCCTTGTCCTCAG<br>GGCTACAGCAGTAGGGAGGTCAGTGCTTCGTGCCTCGATTGAAGGTGACCTCTGCCC<br>CAGATAGGTGGTGCCAGTGGCTTATTAATTCCGATACTAGTTTGCTTTGCTGACCAA<br>ATGCCTGGTACCAGAGGATGGTGAGGCGAAGGCCAGGTTGGGGGCAGTGTTGTGGCC<br>CTGGGGCCCAGCCCCAAACTGGGGGCTCTGTATATAGCTATGAAGAAAACACAAAGT<br>GTATAAATCTGAGTATATATTTACATGTCTTTTTAAAAGGGTCGTTACCAGAGATTT<br>ACCCATCGGGTAAGATGCTCCTGGTGGCTGGGAGGCATCAGTTGCTATATATTAAAA<br>ACAAAAAAGAAAAAAAAGGAAAATGTTTTTAAAAAGGTCATATATTTTTTGCTACTT<br>TTGCTGTTTTATTTTTTTAAATTATGTTCTAAACCTATTTTCAGTTTAGGTCCCTCA<br>ATAAAAATTGCTGCTGCTTCATTTATCTATGGGCTGTATGAAAAGGGTGGGAATGTC<br>CACTGGAAAGAAGGGACACCCACGGGCCCTGGGGCTAGGTCTGTCCCGAGGGCACCG<br>CATGCTCCCGGCGCAGGTTCCTTGTAACCTCTTCTTCCTAGGTCCTGCACCCAGACC<br>TCACGACGCACCTCCTGCCTCTCCGCTGCTTTTGGAAAGTCAGAAAAAGAAGATGTC<br>TGCTTCGAGGGCAGGAACCCCATCCATGCAGTAGAGGCGCTGGGCAGAGAGTCAAGG<br>CCCAGCAGCCATCGACCATGGATGGTTTCCTCCAAGGAAACCGGTGGGGTTGGGCTG<br>GGGAGGGGGCACCTACCTAGGAATAGCCACGGGGTAGAGCTACAGTGATTAAGAGGA<br>AAGCAAGGGCGCGGTTGCTCACGCCTGTAATCCCAGCACTTTGGGACACCGAGGTGG<br>GCAGATCACTTCAGGTCAGGAGTTTGAGACCAGCCTGGCCAACTTAGTGAAACCCCA<br>TCTCTACTAAAAATGCAAAAATTATCCAGGCATGGTGGCACACGCCTGTAATCCCAG<br>CTCCACAGGAGGCTGAGGCAGAATCCCTTGAAGCTGGGAGGCGGAGGTTGCAGTGAG<br>CCGAGATTGCGCCATTGCACTCCAGCCTGGGCAACAGAGAAAACAAAAAGGAAAACA<br>AATGATGAAGGTCTGCAGAAACTGAAACCCAGACATGTGTCTGCCCCCTCTATGTGG<br>GCATGGTTTTGCCAGTGCTTCTAAGTGCAGGAGAACATGTCACCTGAGGCTAGTTTT<br>GCATTCAGGTCCCTGGCTTCGTTTCTTGTTGGTATGCCTCCCCAGATCGTCCTTCCT<br>GTATCCATGTGACCAGACTGTATTTGTTGGGACTGTCGCAGATCTTGGCTTCTTACA<br>GTTCTTCCTGTCCAAACTCCATCCTGTCCCTCAGGAACGGGGGGAAAATTCTCCGAA<br>TGTTTTTGGTTTTTTGGCTGCTTGGAATTTACTTCTGCCACCTGCTGGTCATCACTG<br>TCCTCACTAAGTGGATTCTGGCTCCCCCGTACCTCATGGCTCAAACTACCACTCCTC<br>AGTCGCTATATTAAAGCTTATATTTTGCTGGATTACTGCTAAATACAAAAGAAAGTT<br>CAATATGTTTTCATTTCTGTAGGGAAAATGGGATTGCTGCTTTAAATTTCTGAGCTA<br>GGGATTTTTTGGCAGCTGCAGTGTTGGCGACTATTGTAAAATTCTCTTTGTTTCTCT<br>CTGTAAATAGCACCTGCTAACATTACAATTTGTATTTATGTTTAAAGAAGGCATCAT<br>TTGGTGAACAGAACTAGGAAATGAATTTTTAGCTCTTAAAAGCATTTGCTTTGAGAC<br>CGCACAGGAGTGTCTTTCCTTGTAAAACAGTGATGATAATTTCTGCCTTGGCCCTAC<br>CTTGAAGCAATGTTGTGTGAAGGGATGAAGAATCTAAAAGTCTTCATAAGTCCTTGG<br>GAGAGGTGCTAGAAAAATATAAGGCACTATCATAATTACAGTGATGTCCTTGCTGTT<br>ACTACTCAAATCACCCACAAATTTCCCCAAAGACTGCGCTAGCTGTCAAATAAAAGA<br>CAGTGAAATTGACCTGA |

TABLE 3-continued

| FGFR sequences | | |
|---|---|---|
| SEQ ID NO: 8 | FGFR1 isoform 4 Amino acid sequence | MEARVSLKRRIELTVEYPWRCGALSPTSNCRTGMWSWKCLLFWAVLVTATLCTARPS<br>PTLPEQAQPWGAPVEVESFLVHPGDLLQLRCRLRDDVQSINWLRDGVQLAESNRTRI<br>TGEEVEVQDSVPADSGLYACVTSSPSGSDTTYFSVNVSDALPSSEDDDDDDDSSSEE<br>KETDNTKPNPVAPYWTSPEKMEKKLHAVPAAKTVKFKCPSSGTPNPTLRWLKNGKEF<br>KPDHRIGGYKVRYATWSIIMDSVVPSDKGNYTCIVENEYGSINHTYQLDVVERSPHR<br>PILQAGLPANKTVALGSNVEFMCKVYSDPQPHIQWLKHIEVNGSKIGPDNLPYVQIL<br>KTAGVNTTDKEMEVLHLRNVSFEDAGEYTCLAGNSIGLSHHSAWLTVLEALEERPAV<br>MTSPLYLEIIIYCTGAFLISCMVGSVIVYKMKSGTKKSDFHSQMAVHKLAKSIPLRR<br>QVTVSADSSASMNSGVLLVRPSRLSSSGTPMLAGVSEYELPEDPRWELPRDRLVLGK<br>PLGEGCFGQVVLAEAIGLDKDKPNRVTKVAVKMLKSDATEKDLSDLISEMEMMKMIG<br>KHKNIINLLGACTQDGPLYV**IVEYASKGNLR**EYLQARRPPGLEYCYNPSHNPEEQLS<br>SKDLVSCAYQVARGMEYLASKKCIHRDLAARNVLVTEDNVMKIADFGLARDIHHIDY<br>YKKTTNGRLPVKWMAPEALFDRIYTHQSDVWSFGVLLWEIFTLGGSPYPGVPVEELF<br>KLLKEGHRMDKPSNCTNELYMMMRDCWHAVPSQRPTFKQLVEDLDRIVALTSNQEYL<br>DLSMPLDQYSPSFPDTRSSTCSSGEDSVFSHEPLPEEPCLPRHPAQLANGGLKRR |
| SEQ ID NO: 9 | FGFR1 isoform 5 Nucleic acid sequence | GCGCTCTTGCGGCCACAGGCGCGGCGTCCTCGGCGGCGGGCGGCAGCTAGCGGGAGC<br>CGGGACGCCGGTGCAGCCGCAGCGCGCGGAGGAACCCGGGTGTGCCGGGAGCTGGGC<br>GGCCACGTCCGGACGGGACCGAGACCCCTCGTAGCGCATTGCGGCGACCTCGCCTTC<br>CCCGGCCGCGAGCGCGCCGCTGCTTGAAAAGCCGCGGAACCCAAGGACTTTTCTCCG<br>GTCCGAGCTCGGGGCGCCCCGCAGGGCGCACGGTACCCGTGCTGCAGTCGGGCACGC<br>CGCGGCGCCGGGGCCTCCGCAGGGCGATGGAGCCCGGTCTGCAAGGAAAGTGAGGCG<br>CCGCCGCTGCGTTCTGGAGGAGGGGGGCACAAGGTCTGGAGACCCCGGGTGGCGGAC<br>GGGAGCCCTCCCCCCGCCCCGCCTCCGGGGCACCAGCTCCGGCTCCATTGTTCCCGC<br>CCGGGCTGGAGGCGCCGAGCACCGAGCGCCGCCGGGAGTCGAGCGCCGGCCGCGGAG<br>CTCTTGCGACCCCGCCAGGACCCGAACAGAGCCCGGGGGCGGCGGGCCGGAGCCGGG<br>GACGCGGGCACACGCCCGCTCGCACAAGCCACGGCGGACTCTCCCGAGGCGGAACCT<br>CCACGCCGAGCGAGGGTCAGTTTGAAAAGGAGGATCGAGCTCACTGTGGAGTATCCA<br>TGGAGATGTGGAGCCTTGTCACCAACCTCTAACTGCAGAACTGGGATGTGGAGCTGG<br>AAGTGCCTCCTCTTCTGGGCTGTGCTGGTCACAGCCACACTCTGCACCGCTAGGCCG<br>TCCCCGACCTTGCCTGAACAAGGATGGCAGCTGTGACCCGGGATTTCGGTGAGATGC<br>TTCTGCACTCTGGCCGGGTCCTGCCAGCCGAAGCCCAGCCCTGGGGAGCCCCTGTGG<br>AAGTGGAGTCCTTCCTGGTCCACCCCGGTGACCTGCTGCAGCTTCGCTGTCGGCTGC<br>GGGACGATGTGCAGAGCATCAACTGGCTGCGGGACGGGGTGCAGCTGGCGGAAAGCA<br>ACCGCACCCGCATCACAGGGGAGGAGGTGGAGGTGCAGGACTCCGTGCCCGCAGACT<br>CCGGCCTCTATGCTTGCGTAACCAGCAGCCCCTCGGGCAGTGACACCACCTACTTCT<br>CCGTCAATGTTTCAGATGCTCTCCCCTCCTCGGAGGATGATGATGATGATGATGACT<br>CCTCTTCAGAGGAGAAAGAAACAGATAACACCAAACCAAACCGTATGCCCGTAGCTC<br>CATATTGGACATCCCAGAAAAGATGGAAAAGAAATTGCATGCAGTGCCGGCTGCCA<br>AGACAGTGAAGTTCAAATGCCCTTCCAGTGGGACCCCAAACCCCACACTGCGCTGGT<br>TGAAAAATGGCAAAGAATTCAAACCTGACCACAGAATTGGAGGCTACAAGGTCCGTT<br>ATGCCACCTGGAGCATCATAATGGACTCTGTGGTGCCCTCTGACAAGGGCAACTACA<br>CCTGCATTGTGGAGAATGAGTACGGCAGCATCAACCACACATACCAGCTGGATGTCG<br>TGGAGCGGTCCCCTCACCGGCCCATCCTGCAAGCAGGGTTGCCCGCCAACAAAACAG<br>TGGCCCTGGGTAGCAACGTGGAGTTCATGTGTAAGGTGTACAGTGACCCGCAGCCGC<br>ACATCCAGTGGCTAAAGCACATCGAGGTGAATGGGAGCAAGATTGGCCCAGACAACC<br>TGCCTTATGTCCAGATCTTGAAGACTGCTGGAGTTAATACCACCGACAAAGAGATGG<br>AGGTGCTTCACTTAAGAAATGTCTCCTTTGAGGACGCAGGGGAGTATACGTGCTTGG<br>CGGGTAACTCTATCGGACTCTCCCATCACTCTGCATGGTTGACCGTTCTGGAAGCCC<br>TGGAAGAGAGGCCGGCAGTGATGACCTCGCCCCTGTACCTGGAGATCATCATCTATT<br>GCACAGGGGCCTTCCTCATCTCCTGCATGGTGGGGTCGGTCATCGTCTACAAGATGA<br>AGAGTGGTACCAAGAAGAGTGACTTCCACAGCCAGATGGCTGTGCACAAGCTGGCCA<br>AGAGCATCCCTCTGCGCAGACAGGTGTCTGCTGACTCCAGTGCATCCATGAACTCTG<br>GGGTTCTTCTGGTTCGGCCATCACGGCTCTCCTCCAGTGGGACTCCCATGCTAGCAG<br>GGGTCTCTGAGTATGAGCTTCCCGAAGACCCTCGCTGGGAGCTGCCTCGGGACAGAC<br>TGGTCTTAGGCAAACCCCTGGGAGAGGGCTGCTTTGGGCAGGTGGTGTTGGCAGAGG<br>CTATCGGGCTGGACAAGGACAAACCCAACCGTGTGACCAAAGTGGCTGTGAAGATGT<br>TGAAGTCGGACGCAACAGAGAAAGACTTGTCAGACCTGATCTCAGAAATGGAGATGA<br>TGAAGATGATCGGGAAGCATAAGAATATCATCAACCTGCTGGGGGCCTGCACGCAGG<br>ATGGTCCCTTGTATGTCATCGTGGAGTATGCCTCCAAGGGCAACCTGCGGGAGTACC<br>TGCAGGCCCGGAGGCCCCCAGGGCTGGAATACTGCTACAACCCCAGCCACAACCCAG<br>AGGAGCAGCTCTCCTCCAAGGACCTGGTGTCCTGCGCCTACCAGGTGGCCCGAGGCA<br>TGGAGTATCTGGCCTCCAAGAAGTGCATACACCGAGACCTGGCAGCCAGGAATGTCC<br>TGGTGACAGAGGACAATGTGATGAAGATAGCAGACTTTGGCCTCGCACGGGACATTC<br>ACCACATCGACTACTATAAAAAGACAACCAACGGCCGACTGCCTGTGAAGTGGATGG<br>CACCCGAGGCATTATTTGACCGGATCTACACCCACCAGAGTGATGTGTGGTCTTTCG<br>GGGTGCTCCTGTGGGAGATCTTCACTCTGGGCGGCTCCCCATACCCCGGTGTGCCTG<br>TGGAGGAACTTTTCAAGCTGCTGAAGGAGGGTCACCGCATGGACAAGCCCAGTAACT<br>GCACCAACGAGCTGTACATGATGATGCGGGACTGCTGGCATGCAGTGCCCTCACAGA<br>GACCCACCTTCAAGCAGCTGGTGGAAGACCTGGACCGCATCGTGGCCTTGACCTCCA<br>ACCAGGAGTACCTGGACCTGTCCATGCCCCTGGACCAGTACTCCCCCAGCTTTCCCG<br>ACACCCGGAGCTCTACGTGCTCCTCAGGGGAGGATTCCGTCTTCTCTCATGAGCCGC<br>TGCCCGAGGAGCCCTGCCTGCCCCGACACCCAGCCCAGCTTGCCAATGGCGGACTCA<br>AACGCCGCTGACTGCCACCCACACGCCCTCCCCAGACTCCACCGTCAGCTGTAACCC<br>TCACCCACAGCCCCTGCTGGGCCCACCACCTGTCCGTCCCTGTCCCCTTTCCTGCTG<br>GCAGGAGCCGGCTGCCTACCAGGGGCCTTCCTGTGTGGCCTGCCTTCACCCCACTCA<br>GCTCACCTCTCCCTCCACCTCCTCTCCACCTGCTGGTGAGAGGTGCAAAGAGGCAGA |

TABLE 3-continued

| | FGFR sequences | |
|---|---|---|
| | | TCTTTGCTGCCAGCCACTTCATCCCCTCCCAGATGTTGGACCAACACCCCTCCCTGC<br>CACCAGGCACTGCCTGGAGGGCAGGGAGTGGGAGCCAATGAACAGGCATGCAAGTGA<br>GAGCTTCCTGAGCTTTCTCCTGTCGGTTTGGTCTGTTTTGCCTTCACCCATAAGCCC<br>CTCGCACTCTGGTGGCAGGTGCCTTGTCCTCAGGGCTACAGCAGTAGGGAGGTCAGT<br>GCTTCGTGCCTCGATTGAAGGTGACCTCTGCCCCAGATAGGTGGTGCCAGTGGCTTA<br>TTAATTCCGATACTAGTTTGCTTTGCTGACCAAATGCCTGGTACCAGAGGATGGTGA<br>GGCGAAGGCCAGGTTGGGGGCAGTGTTGTGGCCCTGGGGCCCAGCCCCAAACTGGGG<br>GCTCTGTATATAGCTATGAAGAAAACACAAAGTGTATAAATCTGAGTATATATTTAC<br>ATGTCTTTTTAAAAGGGTCGTTACCAGAGATTTACCCATCGGGTAAGATGCTCCTGG<br>TGGCTGGGAGGCATCAGTTGCTATATATTAAAAACAAAAAAGAAAAAAAAGGAAAAT<br>GTTTTTAAAAAGGTCATATATTTTTTGCTACTTTTGCTGTTTTATTTTTTTAAATTA<br>TGTTCTAAACCTATTTTCAGTTTAGGTCCCTCAATAAAAATTGCTGCTGCTTC |
| SEQ ID<br>NO: 10 | FGFR1<br>isoform 5<br>Amino acid<br>sequence | MAAVTRDFGEMLLHSGRVLPAEAQPWGAPVEVESFLVHPGDLLQLRCRLRDDVQSIN<br>WLRDGVQLAESNRTRITGEEVEVQDSVPADSGLYACVTSSPSGSDTTYFSVNVSDAL<br>PSSEDDDDDDDSSSEEKETDNTKPNRMPVAPYWTSPEKMEKKLHAVPAAKTVKFKCP<br>SSGTPNPTLRWLKNGKEFKPDHRIGGYKVRYATWSIIMDSVVPSDKGNYTCIVENEY<br>GSINHTYQLDVVERSPHRPILQAGLPANKTVALGSNVEFMCKVYSDPQPHIQWLKHI<br>EVNGSKIGPDNLPYVQILKTAGVNTTDKEMEVLHLRNVSFEDAGEYTCLAGNSIGLS<br>HHSAWLTVLEALEERPAVMTSPLYLEIIIYCTGAFLISCMVGSVIVYKMKSGTKKSD<br>FHSQMAVHKLAKSIPLRRQVSADSSASMNSGVLLVRPSRLSSSGTPMLAGVSEYELP<br>EDPRWELPRDRLVLGKPLGEGCFGQVVLAEAIGLDKDKPNRVTKVAVKMLKSDATEK<br>DLSDLISEMEMMKMIGKHKNIINLLGACTQDGPLYV**IVEYASKGNLR**EYLQARRPPG<br>LEYCYNPSHNPEEQLSSKDLVSCAYQVARGMEYLASKKCIHRDLAARNVLVTEDNVM<br>KIADFGLARDIHHIDYYKKTTNGRLPVKWMAPEALFDRIYTHQSDVWSFGVLLWEIF<br>TLGGSPYPGVPVEELFKLLKEGHRMDKPSNCTNELYMMMRDCWHAVPSQRPTFKQLV<br>EDLDRIVALTSNQEYLDLSMPLDQYSPSFPDTRSSTCSSGEDSVFSHEPLPEEPCLP<br>RHPAQLANGGLKRR |
| SEQ ID<br>NO: 11 | FGFR1<br>isoform 6<br>Nucleic acid<br>sequence | CTTGCGGCCACAGGCGCGGCGTCCTCGGCGGCGGGCGGCAGCTAGCGGGAGCCGGGA<br>CGCCGGTGCAGCCGCAGCGCGCGGAGGAACCCGGGTGTGCCGGGAGCTGGGCGGCCA<br>CGTCCGGACGGGACCGAGACCCCTCGTAGCGCATTGCGGCGACCTCGCCTTCCCCGG<br>CCGCGAGCGCGCCGCTGCTTGAAAAGCCGCGGAACCCAAGGACTTTTCTCCGGTCCG<br>AGCTCGGGGCGCCCCGCAGGGCGCACGGTACCCGTGCTGCAGTCGGGCACGCCGCGG<br>CGCCGGGGCCTCCGCAGGGCGATGGAGCCCGGTCTGCAAGGAAAGTGAGGCGCCGCC<br>GCTGCGTTCTGGAGGAGGGGGGCACAAGGTCTGGAGACCCCGGGTGGCGGACGGGAG<br>CCCTCCCCCCGCCCCGCCTCCGGGGCACCAGCTCCGGCTCCATTGTTCCCGCCCGGG<br>CTGGAGGCGCCGAGCACCGAGCGCCGCCGGGAGTCGAGCGCCGGCCGCGGAGCTCTT<br>GCGACCCCGCCAGGACCCGAACAGAGCCCGGGGGCGGCGGGCCGGAGCCGGGGACGC<br>GGGCACACGCCCGCTCGCACAAGCCACGGCGGACTCTCCCGAGGCGGAACCTCCACG<br>CCGAGCGAGGGTCAGTTTGAAAAGGAGGATCGAGCTCACTGTGGAGTATCCATGGAG<br>ATGTGGAGCCTTGTCACCAACCTCTAACTGCAGAACTGGGATGTGGAGCTGGAAGTG<br>CCTCCTCTTCTGGGCTGTGCTGGTCACAGCCACACTCTGCACCGCTAGGCCGTCCCC<br>GACCTTGCCTGAACAAGATGCTCTCCCCTCCTCGGAGGATGATGATGATGATGATGA<br>CTCCTCTTCAGAGGAGAAAGAAACAGATAACACCAAACCAAACCGTATGCCCGTAGC<br>TCCATATTGGACATCCCCAGAAAAGATGGAAAAGAAATTGCATGCAGTGCCGGCTGC<br>CAAGACAGTGAAGTTCAAATGCCCTTCCAGTGGGACCCCAAACCCCACACTGCGCTG<br>GTTGAAAAATGGCAAAGAATTCAAACCTGACCACAGAATTGGAGGCTACAAGGTCCG<br>TTATGCCACCTGGAGCATCATAATGGACTCTGTGGTGCCCTCTGACAAGGGCAACTA<br>CACCTGCATTGTGGAGAATGAGTACGGCAGCATCAACCACACATACCAGCTGGATGT<br>CGTGGAGCGGTCCCCTCACCGGCCCATCCTGCAAGCAGGGTTGCCCGCCAACAAAAC<br>AGTGGCCCTGGGTAGCAACGTGGAGTTCATGTGTAAGGTGTACAGTGACCCGCAGCC<br>GCACATCCAGTGGCTAAAGCACATCGAGGTGAATGGGAGCAAGATTGGCCCAGACAA<br>CCTGCCTTATGTCCAGATCTTGAAGACTGCTGGAGTTAATACCACCGACAAAGAGAT<br>GGAGGTGCTTCACTTAAGAAATGTCTCCTTTGAGGACGCAGGGGAGTATACGTGCTT<br>GGCGGGTAACTCTATCGGACTCTCCCATCACTCTGCATGGTTGACCGTTCTGGAAGC<br>CCTGGAAGAGAGGCCGGCAGTGATGACCTCGCCCCTGTACCTGGAGATCATCATCTA<br>TTGCACAGGGGCCTTCCTCATCTCCTGCATGGTGGGGTCGGTCATCGTCTACAAGAT<br>GAAGAGTGGTACCAAGAAGAGTGACTTCCACAGCCAGATGGCTGTGCACAAGCTGGC<br>CAAGAGCATCCCTCTGCGCAGACAGGTAACAGTGTCTGCTGACTCCAGTGCATCCAT<br>GAACTCTGGGGTTCTTCTGGTTCGGCCATCACGGCTCTCCTCCAGTGGGACTCCCAT<br>GCTAGCAGGGGTCTCTGAGTATGAGCTTCCCGAAGACCCTCGCTGGGAGCTGCCTCG<br>GGACAGACTGGTCTTAGGCAAACCCCTGGGAGAGGGCTGCTTTGGGCAGGTGGTGTT<br>GGCAGAGGCTATCGGGCTGGACAAGGACAAACCCAACCGTGTGACCAAAGTGGCTGT<br>GAAGATGTTGAAGTCGGACGCAACAGAGAAAGACTTGTCAGACCTGATCTCAGAAAT<br>GGAGATGATGAAGATGATCGGGAAGCATAAGAATATCATCAACCTGCTGGGGGCCTG<br>CACGCAGGATGGTCCCTTGTATGTCATCGTGGAGTATGCCTCCAAGGGCAACCTGCG<br>GGAGTACCTGCAGGCCCGGAGGCCCCCAGGGCTGGAATACTGCTACAACCCCAGCCA<br>CAACCCAGAGGAGCAGCTCTCCTCCAAGGACCTGGTGTCCTGCGCCTACCAGGTGGC<br>CCGAGGCATGGAGTATCTGGCCTCCAAGAAGTGCATACACCGAGACCTGGCAGCCAG<br>GAATGTCCTGGTGACAGAGGACAATGTGATGAAGATAGCAGACTTTGGCCTCGCACG<br>GGACATTCACCACATCGACTACTATAAAAAGACAACCAACGGCCGACTGCCTGTGAA<br>GTGGATGGCACCCGAGGCATTATTTGACCGGATCTACACCCACCAGAGTGATGTGTG<br>GTCTTTCGGGGTGCTCCTGTGGGAGATCTTCACTCTGGGCGGCTCCCCATACCCCGG<br>TGTGCCTGTGGAGGAACTTTTCAAGCTGCTGAAGGAGGGTCACCGCATGGACAAGCC<br>CAGTAACTGCACCAACGAGCTGTACATGATGATGCGGGACTGCTGGCATGCAGTGCC<br>CTCACAGAGACCCACCTTCAAGCAGCTGGTGGAAGACCTGGACCGCATCGTGGCCTT<br>GACCTCCAACCAGGAGTACCTGGACCTGTCCATGCCCCTGGACCAGTACTCCCCCAG |

TABLE 3-continued

| FGFR sequences | | |
|---|---|---|
| | | CTTTCCCGACACCCGGAGCTCTACGTGCTCCTCAGGGGAGGATTCCGTCTTCTCTCA<br>TGAGCCGCTGCCCGAGGAGCCCTGCCTGCCCCGACACCCAGCCCAGCTTGCCAATGG<br>CGGACTCAAACGCCGCTGACTGCCACCCACACGCCCTCCCCAGACTCCACCGTCAGC<br>TGTAACCCTCACCCACAGCCCCTGCTGGGCCCACCACCTGTCCGTCCCTGTCCCCTT<br>TCCTGCTGGCAGGAGCCGGCTGCCTACCAGGGGCCTTCCTGTGTGGCCTGCCTTCAC<br>CCCACTCAGCTCACCTCTCCCTCCACCTCCTCTCCACCTGCTGGTGAGAGGTGCAAA<br>GAGGCAGATCTTTGCTGCCAGCCACTTCATCCCCTCCCAGATGTTGGACCAACACCC<br>CTCCCTGCCACCAGGCACTGCCTGGAGGGCAGGGAGTGGGAGCCAATGAACAGGCAT<br>GCAAGTGAGAGCTTCCTGAGCTTTCTCCTGTCGGTTTGGTCTGTTTTGCCTTCACCC<br>ATAAGCCCCTCGCACTCTGGTGGCAGGTGCCTTGTCCTCAGGGCTACAGCAGTAGGG<br>AGGTCAGTGCTTCGTGCCTCGATTGAAGGTGACCTCTGCCCCAGATAGGTGGTGCCA<br>GTGGCTTATTAATTCCGATACTAGTTTGCTTTGCTGACCAAATGCCTGGTACCAGAG<br>GATGGTGAGGCGAAGGCCAGGTTGGGGGCAGTGTTGTGGCCCTGGGGCCCAGCCCCA<br>AACTGGGGGCTCTGTATATAGCTATGAAGAAAACACAAAGTGTATAAATCTGAGTAT<br>ATATTTACATGTCTTTTTAAAAGGGTCGTTACCAGAGATTTACCCATCGGGTAAGAT<br>GCTCCTGGTGGCTGGGAGGCATCAGTTGCTATATATTAAAAACAAAAAAGAAAAAAA<br>AGGAAAATGTTTTTAAAAAGGTCATATATTTTTTGCTACTTTTGCTGTTTTATTTTT<br>TTAAATTATGTTCTAAACCTATTTTCAGTTTAGGTCCCTCAATAAAAATTGCTGCTG<br>CTTCA |
| SEQ ID NO: 12 | FGFR1 isoform 6 Amino acid sequence | MWSWKCLLFWAVLVTATLCTARPSPTLPEQDALPSSEDDDDDDDSSSEEKETDNTKP<br>NRMPVAPYWTSPEKMEKKLHAVPAAKTVKFKCPSSGTPNPTLRWLKNGKEFKPDHRI<br>GGYKVRYATWSIIMDSVVPSDKGNYTCIVENEYGSINHTYQLDVVERSPHRPILQAG<br>LPANKTVALGSNVEFMCKVYSDPQPHIQWLKHIEVNGSKIGPDNLPYVQILKTAGVN<br>TTDKEMEVLHLRNVSFEDAGEYTCLAGNSIGLSHHSAWLTVLEALEERPAVMTSPLY<br>LEIIIYCTGAFLISCMVGSVIVYKMKSGTKKSDFHSQMAVHKLAKSIPLRRQVTVSA<br>DSSASMNSGVLLVRPSRLSSSGTPMLAGVSEYELPEDPRWELPRDRLVLGKPLGEGC<br>FGQVVLAEAIGLDKDKPNRVTKVAVKMLKSDATEKDLSDLISEMEMMKMIGKHKNII<br>NLLGACTQDGPLYV**IVEYASKGNLR**EYLQARRPPGLEYCYNPSHNPEEQLSSKDLVS<br>CAYQVARGMEYLASKKCIHRDLAARNVLVTEDNVMKIADFGLARDIHHIDYYKKTTN<br>GRLPVKWMAPEALFDRIYTHQSDVWSFGVLLWEIFTLGGSPYPGVPVEELFKLLKEG<br>HRMDKPSNCTNELYMMMRDCWHAVPSQRPTFKQLVEDLDRIVALTSNQEYLDLSMPL<br>DQYSPSFPDTRSSTCSSGEDSVFSHEPLPEEPCLPRHPAQLANGGLKRR |
| SEQ ID NO: 13 | FGFR1 isoform 7 Nucleic acid sequence | CTTGCGGCCACAGGCGCGGCGTCCTCGGCGGCGGGCGGCAGCTAGCGGGAGCCGGGA<br>CGCCGGTGCAGCCGCAGCGCGCGGAGGAACCCGGGTGTGCCGGGAGCTGGGCGGCCA<br>CGTCCGGACGGGACCGAGACCCCTCGTAGCGCATTGCGGCGACCTCGCCTTCCCCGG<br>CCGCGAGCGCGCCGCTGCTTGAAAAGCCGCGGAACCCAAGGACTTTTCTCCGGTCCG<br>AGCTCGGGGCGCCCCGCAGGGCGCACGGTACCCGTGCTGCAGTCGGGCACGCCGCGG<br>CGCCGGGGCCTCCGCAGGGCGATGGAGCCCGGTCTGCAAGGAAAGTGAGGCGCCGCC<br>GCTGCGTTCTGGAGGAGGGGGGCACAAGGTCTGGAGACCCCGGGTGGCGGACGGGAG<br>CCCTCCCCCCGCCCCGCCTCCGGGGCACCAGCTCCGGCTCCATTGTTCCCGCCCGGG<br>CTGGAGGCGCCGAGCACCGAGCGCCGCCGGGAGTCGAGCGCCGGCCGCGGAGCTCTT<br>GCGACCCCGCCAGGACCCGAACAGAGCCCGGGGGCGGCGGGCCGGAGCCGGGGACGC<br>GGGCACACGCCCGCTCGCACAAGCCACGGCGGACTCTCCCGAGGCGGAACCTCCACG<br>CCGAGCGAGGGTCAGTTTGAAAAGGAGGATCGAGCTCACTGTGGAGTATCCATGGAG<br>ATGTGGAGCCTTGTCACCAACCTCTAACTGCAGAACTGGGATGTGGAGCTGGAAGTG<br>CCTCCTCTTCTGGGCTGTGCTGGTCACAGCCACACTCTGCACCGCTAGGCCGTCCCC<br>GACCTTGCCTGAACAAGATGCTCTCCCCTCCTCGGAGGATGATGATGATGATGATGA<br>CTCCTCTTCAGAGGAGAAAGAAACAGATAACACCAAACCAAACCCCGTAGCTCCATA<br>TTGGACATCCCCAGAAAAGATGGAAAAGAAATTGCATGCAGTGCCGGCTGCCAAGAC<br>AGTGAAGTTCAAATGCCCTTCCAGTGGGACCCCAAACCCCACACTGCGCTGGTTGAA<br>AAATGGCAAAGAATTCAAACCTGACCACAGAATTGGAGGCTACAAGGTCCGTTATGC<br>CACCTGGAGCATCATAATGGACTCTGTGGTGCCCTCTGACAAGGGCAACTACACCTG<br>CATTGTGGAGAATGAGTACGGCAGCATCAACCACACATACCAGCTGGATGTCGTGGA<br>GCGGTCCCCTCACCGGCCCATCCTGCAAGCAGGGTTGCCCGCCAACAAAACAGTGGC<br>CCTGGGTAGCAACGTGGAGTTCATGTGTAAGGTGTACAGTGACCCGCAGCCGCACAT<br>CCAGTGGCTAAAGCACATCGAGGTGAATGGGAGCAAGATTGGCCCAGACAACCTGCC<br>TTATGTCCAGATCTTGAAGACTGCTGGAGTTAATACCACCGACAAAGAGATGGAGGT<br>GCTTCACTTAAGAAATGTCTCCTTTGAGGACGCAGGGGAGTATACGTGCTTGGCGGG<br>TAACTCTATCGGACTCTCCCATCACTCTGCATGGTTGACCGTTCTGGAAGCCCTGGA<br>AGAGAGGCCGGCAGTGATGACCTCGCCCCTGTACCTGGAGATCATCATCTATTGCAC<br>AGGGGCCTTCCTCATCTCCTGCATGGTGGGGTCGGTCATCGTCTACAAGATGAAGAG<br>TGGTACCAAGAAGAGTGACTTCCACAGCCAGATGGCTGTGCACAAGCTGGCCAAGAG<br>CATCCCTCTGCGCAGACAGGTAACAGTGTCTGCTGACTCCAGTGCATCCATGAACTC<br>TGGGGTTCTTCTGGTTCGGCCATCACGGCTCTCCTCCAGTGGGACTCCCATGCTAGC<br>AGGGGTCTCTGAGTATGAGCTTCCCGAAGACCCTCGCTGGGAGCTGCCTCGGGACAG<br>ACTGGTCTTAGGCAAACCCCTGGGAGAGGGCTGCTTTGGGCAGGTGGTGTTGGCAGA<br>GGCTATCGGGCTGGACAAGGACAAACCCAACCGTGTGACCAAAGTGGCTGTGAAGAT<br>GTTGAAGTCGGACGCAACAGAGAAAGACTTGTCAGACCTGATCTCAGAAATGGAGAT<br>GATGAAGATGATCGGGAAGCATAAGAATATCATCAACCTGCTGGGGGCCTGCACGCA<br>GGATGGTCCCTTGTATGTCATCGTGGAGTATGCCTCCAAGGGCAACCTGCGGGAGTA<br>CCTGCAGGCCCGGAGGCCCCCAGGGCTGGAATACTGCTACAACCCCAGCCACAACCC<br>AGAGGAGCAGCTCTCCTCCAAGGACCTGGTGTCCTGCGCCTACCAGGTGGCCCGAGG<br>CATGGAGTATCTGGCCTCCAAGAAGTGCATACACCGAGACCTGGCAGCCAGGAATGT<br>CCTGGTGACAGAGGACAATGTGATGAAGATAGCAGACTTTGGCCTCGCACGGGACAT<br>TCACCACATCGACTACTATAAAAAGACAACCAACGGCCGACTGCCTGTGAAGTGGAT<br>GGCACCCGAGGCATTATTTGACCGGATCTACACCCACCAGAGTGATGTGTGGTCTTT |

TABLE 3-continued

| FGFR sequences | | |
|---|---|---|
| | | CGGGGTGCTCCTGTGGGAGATCTTCACTCTGGGCGGCTCCCCATACCCCGGTGTGCC<br>TGTGGAGGAACTTTTCAAGCTGCTGAAGGAGGGTCACCGCATGGACAAGCCCAGTAA<br>CTGCACCAACGAGCTGTACATGATGATGCGGGACTGCTGGCATGCAGTGCCCTCACA<br>GAGACCCACCTTCAAGCAGCTGGTGGAAGACCTGGACCGCATCGTGGCCTTGACCTC<br>CAACCAGGAGTACCTGGACCTGTCCATGCCCCTGGACCAGTACTCCCCCAGCTTTCC<br>CGACACCCGGAGCTCTACGTGCTCCTCAGGGGAGGATTCCGTCTTCTCTCATGAGCC<br>GCTGCCCGAGGAGCCCTGCCTGCCCCGACACCCAGCCCAGCTTGCCAATGGCGGACT<br>CAAACGCCGCTGACTGCCACCCACACGCCCTCCCCAGACTCCACCGTCAGCTGTAAC<br>CCTCACCCACAGCCCCTGCTGGGCCCACCACCTGTCCGTCCCTGTCCCCTTTCCTGC<br>TGGCAGGAGCCGGCTGCCTACCAGGGGCCTTCCTGTGTGGCCTGCCTTCACCCCACT<br>CAGCTCACCTCTCCCTCCACCTCCTCTCCACCTGCTGGTGAGAGGTGCAAAGAGGCA<br>GATCTTTGCTGCCAGCCACTTCATCCCCTCCCAGATGTTGGACCAACACCCCTCCCT<br>GCCACCAGGCACTGCCTGGAGGGCAGGGAGTGGGAGCCAATGAACAGGCATGCAAGT<br>GAGAGCTTCCTGAGCTTTCTCCTGTCGGTTTGGTCTGTTTTGCCTTCACCCATAAGC<br>CCCTCGCACTCTGGTGGCAGGTGCCTTGTCCTCAGGGCTACAGCAGTAGGGAGGTCA<br>GTGCTTCGTGCCTCGATTGAAGGTGACCTCTGCCCCAGATAGGTGGTGCCAGTGGCT<br>TATTAATTCCGATACTAGTTTGCTTTGCTGACCAAATGCCTGGTACCAGAGGATGGT<br>GAGGCGAAGGCCAGGTTGGGGGCAGTGTTGTGGCCCTGGGGCCCAGCCCCAAACTGG<br>GGGCTCTGTATATAGCTATGAAGAAAACACAAAGTGTATAAATCTGAGTATATATTT<br>ACATGTCTTTTTAAAAGGGTCGTTACCAGAGATTTACCCATCGGGTAAGATGCTCCT<br>GGTGGCTGGGAGGCATCAGTTGCTATATATTAAAAACAAAAAAGAAAAAAAAAGGAAA<br>ATGTTTTTAAAAAGGTCATATATTTTTTGCTACTTTTGCTGTTTTATTTTTTTAAAT<br>TATGTTCTAAACCTATTTTCAGTTTAGGTCCCTCAATAAAAATTGCTGCTGCTT |
| SEQ ID NO: 14 | FGFR1 isoform 7 Amino acid sequence | MWSWKCLLFWAVLVTATLCTARPSPTLPEQDALPSSEDDDDDDDSSSEEKETDNTKP<br>NPVAPYWTSPEKMEKKLHAVPAAKTVKFKCPSSGTPNPTLRWLKNGKEFKPDHRIGG<br>YKVRYATWSIIMDSVVPSDKGNYTCIVENEYGSINHTYQLDVVERSPHRPILQAGLP<br>ANKTVALGSNVEFMCKVYSDPQPHIQWLKHIEVNGSKIGPDNLPYVQILKTAGVNTT<br>DKEMEVLHLRNVSFEDAGEYTCLAGNSIGLSHHSAWLTVLEALEERPAVMTSPLYLE<br>IIIYCTGAFLISCMVGSVIVYKMKSGTKKSDFHSQMAVHKLAKSIPLRRQVTVSADS<br>SASMNSGVLLVRPSRLSSSGTPMLAGVSEYELPEDPRWELPRDRLVLGKPLGEGCFG<br>QVVLAEAIGLDKDKPNRVTKVAVKMLKSDATEKDLSDLISEMEMMKMIGKHKNIINL<br>LGACTQDGPLYV**IVEYASKGNLR**EYLQARRPPGLEYCYNPSHNPEEQLSSKDLVSCA<br>YQVARGMEYLASKKCIHRDLAARNVLVTEDNVMKIADFGLARDIHHIDYYKKTTNGR<br>LPVKWMAPEALFDRIYTHQSDVWSFGVLLWEIFTLGGSPYPGVPVEELFKLLKEGHR<br>MDKPSNCTNELYMMMRDCWHAVPSQRPTFKQLVEDLDRIVALTSNQEYLDLSMPLDQ<br>YSPSFPDTRSSTCSSGEDSVFSHEPLPEEPCLPRHPAQLANGGLKRR |
| SEQ ID NO: 15 | FGFR1 isoform 8 Nucleic acid sequence | GCTTTGCCCGCCGCAGCCCAGCCGGGGCCGGCGCCTCCCTCCGCTCGCCGCCCGCCC<br>CTTTCACCTCCTGGCTCCCTCCCGGGCGATCCGCGCCCCTTGGGTCTCCCCTCCCTT<br>CCCTCCGTCCGCGTCTCCTGCGCCCCCTCCCTGCGCTCGTCCCGCCGCTCTTCCCGC<br>CGCCCAACTTTTCCTCCAACTCGCGCTCGGGAGCTGGCGAGGCGGCGGCGGCTCCTC<br>AGGTCAGTTTGAAAAGGAGGATCGAGCTCACTGTGGAGTATCCATGGAGATGTGGAG<br>CCTTGTCACCAACCTCTAACTGCAGAACTGGGATGTGGAGCTGGAAGTGCCTCCTCT<br>TCTGGGCTGTGCTGGTCACAGCCACACTCTGCACCGCTAGGCCGTCCCCGACCTTGC<br>CTGAACAAGCCCAGCCCTGGGGAGCCCCTGTGGAAGTGGAGTCCTTCCTGGTCCACC<br>CCGGTGACCTGCTGCAGCTTCGCTGTCGGCTGCGGGACGATGTGCAGAGCATCAACT<br>GGCTGCGGGACGGGGTGCAGCTGGCGGAAAGCAACCGCACCCGCATCACAGGGGAGG<br>AGGTGGAGGTGCAGGACTCCGTGCCCGCAGACTCCGGCCTCTATGCTTGCGTAACCA<br>GCAGCCCCTCGGGCAGTGACACCACCTACTTCTCCGTCAATGTTTCAGATGCTCTCC<br>CCTCCTCGGAGGATGATGATGATGATGATGACTCCTCTTCAGAGGAGAAAGAAACAG<br>ATAACACCAAACCAAACCCCGTAGCTCCATATTGGACATCCCCAGAAAAGATGGAAA<br>AGAAATTGCATGCAGTGCCGGCTGCCAAGACAGTGAAGTTCAAATGCCCTTCCAGTG<br>GGACCCCAAACCCCACACTGCGCTGGTTGAAAAATGGCAAAGAATTCAAACCTGACC<br>ACAGAATTGGAGGCTACAAGGTCCGTTATGCCACCTGGAGCATCATAATGGACTCTG<br>TGGTGCCCTCTGACAAGGGCAACTACACCTGCATTGTGGAGAATGAGTACGGCAGCA<br>TCAACCACACATACCAGCTGGATGTCGTGGAGCGGTCCCCTCACCGGCCCATCCTGC<br>AAGCAGGGTTGCCCGCCAACAAAACAGTGGCCCTGGGTAGCAACGTGGAGTTCATGT<br>GTAAGGTGTACAGTGACCCGCAGCCGCACATCCAGTGGCTAAAGCACATCGAGGTGA<br>ATGGGAGCAAGATTGGCCCAGACAACCTGCCTTATGTCCAGATCTTGAAGACTGCTG<br>GAGTTAATACCACCGACAAAGAGATGGAGGTGCTTCACTTAAGAAATGTCTCCTTTG<br>AGGACGCAGGGGAGTATACGTGCTTGGCGGGTAACTCTATCGGACTCTCCCATCACT<br>CTGCATGGTTGACCGTTCTGGAAGCCCTGGAAGAGAGGCCGGCAGTGATGACCTCGC<br>CCCTGTACCTGGAGATCATCATCTATTGCACAGGGGCCTTCCTCATCTCCTGCATGG<br>TGGGGTCGGTCATCGTCTACAAGATGAAGAGTGGTACCAAGAAGAGTGACTTCCACA<br>GCCAGATGGCTGTGCACAAGCTGGCCAAGAGCATCCCTCTGCGCAGACAGGTAACAG<br>TGTCTGCTGACTCCAGTGCATCCATGAACTCTGGGGTTCTTCTGGTTCGGCCATCAC<br>GGCTCTCCTCCAGTGGGACTCCCATGCTAGCAGGGGTCTCTGAGTATGAGCTTCCCG<br>AAGACCCTCGCTGGGAGCTGCCTCGGGACAGACTGGTCTTAGGCAAACCCCTGGGAG<br>AGGGCTGCTTTGGGCAGGTGGTGTTGGCAGAGGCTATCGGGCTGGACAAGGACAAAC<br>CCAACCGTGTGACCAAAGTGGCTGTGAAGATGTTGAAGTCGGACGCAACAGAGAAAG<br>ACTTGTCAGACCTGATCTCAGAAATGGAGATGATGAAGATGATCGGGAAGCATAAGA<br>ATATCATCAACCTGCTGGGGGCCTGCACGCAGGATGGTCCCTTGTATGTCATCGTGG<br>AGTATGCCTCCAAGGGCAACCTGCGGGAGTACCTGCAGGCCCGGAGGCCCCCAGGGC<br>TGGAATACTGCTACAACCCCAGCCACAACCCAGAGGAGCAGCTCTCCTCCAAGGACC<br>TGGTGTCCTGCGCCTACCAGGTGGCCCGAGGCATGGAGTATCTGGCCTCCAAGAAGT<br>GCATACACCGAGACCTGGCAGCCAGGAATGTCCTGGTGACAGAGGACAATGTGATGA<br>AGATAGCAGACTTTGGCCTCGCACGGGACATTCACCACATCGACTACTATAAAAAGA |

TABLE 3-continued

| FGFR sequences | | |
|---|---|---|
| | | CAACCAACGGCCGACTGCCTGTGAAGTGGATGGCACCCGAGGCATTATTTGACCGGA<br>TCTACACCCACCAGAGTGATGTGTGGTCTTTCGGGGTGCTCCTGTGGGAGATCTTCA<br>CTCTGGGCGGCTCCCCATACCCCGGTGTGCCTGTGGAGGAACTTTTCAAGCTGCTGA<br>AGGAGGGTCACCGCATGGACAAGCCCAGTAACTGCACCAACGAGCTGTACATGATGA<br>TGCGGGACTGCTGGCATGCAGTGCCCTCACAGAGACCCACCTTCAAGCAGCTGGTGG<br>AAGACCTGGACCGCATCGTGGCCTTGACCTCCAACCAGGAGTACCTGGACCTGTCCA<br>TGCCCCTGGACCAGTACTCCCCCAGCTTTCCCGACACCCGGAGCTCTACGTGCTCCT<br>CAGGGGAGGATTCCGTCTTCTCTCATGAGCCGCTGCCCGAGGAGCCCTGCCTGCCCC<br>GACACCCAGCCCAGCTTGCCAATGGCGGACTCAAACGCCGCTGACTGCCACCCACAC<br>GCCCTCCCCAGACTCCACCGTCAGCTGTAACCCTCACCCACAGCCCCTGCTGGGCCC<br>ACCACCTGTCCGTCCCTGTCCCCTTTCCTGCTGGCAGGAGCCGGCTGCCTACCAGGG<br>GCCTTCCTGTGTGGCCTGCCTTCACCCCACTCAGCTCACCTCTCCCTCCACCTCCTC<br>TCCACCTGCTGGTGAGAGGTGCAAAGAGGCAGATCTTTGCTGCCAGCCACTTCATCC<br>CCTCCCAGATGTTGGACCAACACCCCTCCCTGCCACCAGGCACTGCCTGGAGGGCAG<br>GGAGTGGGAGCCAATGAACAGGCATGCAAGTGAGAGCTTCCTGAGCTTTCTCCTGTC<br>GGTTTGGTCTGTTTTGCCTTCACCCATAAGCCCCTCGCACTCTGGTGGCAGGTGCCT<br>TGTCCTCAGGGCTACAGCAGTAGGGAGGTCAGTGCTTCGTGCCTCGATTGAAGGTGA<br>CCTCTGCCCCAGATAGGTGGTGCCAGTGGCTTATTAATTCCGATACTAGTTTGCTTT<br>GCTGACCAAATGCCTGGTACCAGAGGATGGTGAGGCGAAGGCCAGGTTGGGGGCAGT<br>GTTGTGGCCCTGGGGCCCAGCCCCAAACTGGGGGCTCTGTATATAGCTATGAAGAAA<br>ACACAAAGTGTATAAATCTGAGTATATATTTACATGTCTTTTTAAAAGGGTCGTTAC<br>CAGAGATTTACCCATCGGGTAAGATGCTCCTGGTGGCTGGGAGGCATCAGTTGCTAT<br>ATATTAAAAACAAAAAAGAAAAAAAAAGGAAAATGTTTTTAAAAAGGTCATATATTTT<br>TTGCTACTTTTGCTGTTTTATTTTTTTAAATTATGTTCTAAACCTATTTTCAGTTTA<br>GGTCCCTCAATAAAAATTGCTGCTGCTTCATT |
| SEQ ID NO: 16 | FGFR1 isoform 8 Amino acid sequence | MWSWKCLLFWAVLVTATLCTARPSPTLPEQAQPWGAPVEVESFLVHPGDLLQLRCRL<br>RDDVQSINWLRDGVQLAESNRTRITGEEVEVQDSVPADSGLYACVTSSPSGSDTTYF<br>SVNVSDALPSSEDDDDDDDSSSEEKETDNTKPNPVAPYWTSPEKMEKKLHAVPAAKT<br>VKFKCPSSGTPNPTLRWLKNGKEFKPDHRIGGYKVRYATWSIIMDSVVPSDKGNYTC<br>IVENEYGSINHTYQLDVVERSPHRPILQAGLPANKTVALGSNVEFMCKVYSDPQPHI<br>QWLKHIEVNGSKIGPDNLPYVQILKTAGVNTTDKEMEVLHLRNVSFEDAGEYTCLAG<br>NSIGLSHHSAWLTVLEALEERPAVMTSPLYLEIIIYCTGAFLISCMVGSVIVYKMKS<br>GTKKSDFHSQMAVHKLAKSIPLRRQVTVSADSSASMNSGVLLVRPSRLSSSGTPMLA<br>GVSEYELPEDPRWELPRDRLVLGKPLGEGCFGQVVLAEAIGLDKDKPNRVTKVAVKM<br>LKSDATEKDLSDLISEMEMMKMIGKHKNIINLLGACTQDGPLYV**IVEYASKGNLR**EY<br>LQARRPPGLEYCYNPSHNPEEQLSSKDLVSCAYQVARGMEYLASKKCIHRDLAARNV<br>LVTEDNVMKIADFGLARDIHHIDYYKKTTNGRLPVKWMAPEALFDRIYTHQSDVWSF<br>GVLLWEIFTLGGSPYPGVPVEELFKLLKEGHRMDKPSNCTNELYMMMRDCWHAVPSQ<br>RPTFKQLVEDLDRIVALTSNQEYLDLSMPLDQYSPSFPDTRSSTCSSGEDSVFSHEP<br>LPEEPCLPRHPAQLANGGLKRR |
| SEQ ID NO: 17 | FGFR1 isoform 9 Nucleic acid sequence | AACTTTTCCTCCAACTCGCGCTCGGGAGCTGGCGAGGCGGCGGCTCCTCAAAGT<br>GGGAGAGCTTCAAGGTCACGTGGTCCGTCCAGCCCCTGCTATCTCACCAGACACTGT<br>CCACCCTGTATGTTGGATCAGTACTCCAGTGAGAAGACAGCAGGCACTTTCACCCAT<br>GCAGCCCATTCAGTCTTCATAACCACCTGTGATGGAGGCAAGGGTCAGTTTGAAAAG<br>GAGGATCGAGCTCACTGTGGAGTATCCATGGAGATGTGGAGCCTTGTCACCAACCTC<br>TAACTGCAGAACTGGGATGTGGAGCTGGAAGTGCCTCCTCTTCTGGGCTGTGCTGGT<br>CACAGCCACACTCTGCACCGCTAGGCCGTCCCCGACCTTGCCTGAACAAGCCCAGCC<br>CTGGGGAGCCCCTGTGGAAGTGGAGTCCTTCCTGGTCCACCCCGGTGACCTGCTGCA<br>GCTTCGCTGTCGGCTGCGGGACGATGTGCAGAGCATCAACTGGCTGCGGGACGGGGT<br>GCAGCTGGCGGAAAGCAACCGCACCCGCATCACAGGGGAGGAGGTGGAGGTGCAGGA<br>CTCCGTGCCCGCAGACTCCGGCCTCTATGCTTGCGTAACCAGCAGCCCCTCGGGCAG<br>TGACACCACCTACTTCTCCGTCAATGTTTCAGATGCTCTCCCCTCCTCGGAGGATGA<br>TGATGATGATGATGACTCCTCTTCAGAGGAGAAAGAAACAGATAACACCAAACCAAA<br>CCCCGTAGCTCCATATTGGACATCCCCAGAAAAGATGGAAAAGAAATTGCATGCAGT<br>GCCGGCTGCCAAGACAGTGAAGTTCAAATGCCCTTCCAGTGGGACCCCAAACCCCAC<br>ACTGCGCTGGTTGAAAAATGGCAAAGAATTCAAACCTGACCACAGAATTGGAGGCTA<br>CAAGGTCCGTTATGCCACCTGGAGCATCATAATGGACTCTGTGGTGCCCTCTGACAA<br>GGGCAACTACACCTGCATTGTGGAGAATGAGTACGGCAGCATCAACCACACATACCA<br>GCTGGATGTCGTGGAGCGGTCCCCTCACCGGCCCATCCTGCAAGCAGGGTTGCCCGC<br>CAACAAAACAGTGGCCCTGGGTAGCAACGTGGAGTTCATGTGTAAGGTGTACAGTGA<br>CCCGCAGCCGCACATCCAGTGGCTAAAGCACATCGAGGTGAATGGGAGCAAGATTGG<br>cCCAGACAACCTGCCTTATGTCCAGATCTTGAAGACTGCTGGAGTTAATACCACCGA<br>CAAAGAGATGGAGGTGCTTCACTTAAGAAATGTCTCCTTTGAGGACGCAGGGGAGTA<br>TACGTGCTTGGCGGGTAACTCTATCGGACTCTCCCATCACTCTGCATGGTTGACCGT<br>TCTGGAAGCCCTGGAAGAGAGGCCGGCAGTGATGACCTCGCCCCTGTACCTGGAGAT<br>CATCATCTATTGCACAGGGGCCTTCCTCATCTCCTGCATGGTGGGGTCGGTCATCGT<br>CTACAAGATGAAGAGTGGTACCAAGAAGAGTGACTTCCACAGCCAGATGGCTGTGCA<br>CAAGCTGGCCAAGAGCATCCCTCTGCGCAGACAGGTAACAGTGTCTGCTGACTCCAG<br>TGCATCCATGAACTCTGGGGTTCTTCTGGTTCGGCCATCACGGCTCTCCTCCAGTGG<br>GACTCCCATGCTAGCAGGGGTCTCTGAGTATGAGCTTCCCGAAGACCCTCGCTGGGA<br>GCTGCCTCGGGACAGACTGGTCTTAGGCAAACCCCTGGGAGAGGGCTGCTTTGGGCA<br>GGTGGTGTTGGCAGAGGCTATCGGGCTGGACAAGGACAAACCCAACCGTGTGACCAA<br>AGTGGCTGTGAAGATGTTGAAGTCGGACGCAACAGAGAAAGACTTGTCAGACCTGAT<br>CTCAGAAATGGAGATGATGAAGATGATCGGGAAGCATAAGAATATCATCAACCTGCT<br>GGGGGCCTGCACGCAGGATGGTCCCTTGTATGTCATCGTGGAGTATGCCTCCAAGGG<br>CAACCTGCGGGAGTACCTGCAGGCCCGGAGGCCCCCAGGGCTGGAATACTGCTACAA |

TABLE 3-continued

| FGFR sequences | | |
|---|---|---|
| | | CCCCAGCCACAACCCAGAGGAGCAGCTCTCCTCCAAGGACCTGGTGTCCTGCGCCTA<br>CCAGGTGGCCCGAGGCATGGAGTATCTGGCCTCCAAGAAGTGCATACACCGAGACCT<br>GGCAGCCAGGAATGTCCTGGTGACAGAGGACAATGTGATGAAGATAGCAGACTTTGG<br>CCTCGCACGGGACATTCACCACATCGACTACTATAAAAAGACAACCAACGGCCGACT<br>GCCTGTGAAGTGGATGGCACCCGAGGCATTATTTGACCGGATCTACACCCACCAGAG<br>TGATGTGTGGTCTTTCGGGGTGCTCCTGTGGGAGATCTTCACTCTGGGCGGCTCCCC<br>ATACCCCGGTGTGCCTGTGGAGGAACTTTTCAAGCTGCTGAAGGAGGGTCACCGCAT<br>GGACAAGCCCAGTAACTGCACCAACGAGCTGTACATGATGATGCGGGACTGCTGGCA<br>TGCAGTGCCCTCACAGAGACCCACCTTCAAGCAGCTGGTGGAAGACCTGGACCGCAT<br>CGTGGCCTTGACCTCCAACCAGGAGTACCTGGACCTGTCCATGCCCCTGGACCAGTA<br>CTCCCCCAGCTTTCCCGACACCCGGAGCTCTACGTGCTCCTCAGGGGAGGATTCCGT<br>CTTCTCTCATGAGCCGCTGCCCGAGGAGCCCTGCCTGCCCCGACACCCAGCCCAGCT<br>TGCCAATGGCGGACTCAAACGCCGCTGACTGCCACCCACACGCCCTCCCCAGACTCC<br>ACCGTCAGCTGTAACCCTCACCCACAGCCCCTGCTGGGCCCACCACCTGTCCGTCCC<br>TGTCCCCTTTCCTGCTGGCA |
| SEQ ID NO: 18 | FGFR1 isoform 9 Amino acid sequence | MWSWKCLLFWAVLVTATLCTARPSPTLPEQAQPWGAPVEVESFLVHPGDLLQLRCRL<br>RDDVQSINWLRDGVQLAESNRTRITGEEVEVQDSVPADSGLYACVTSSPSGSDTTYF<br>SVNVSDALPSSEDDDDDDDSSSEEKETDNTKPNPVAPYWTSPEKMEKKLHAVPAAKT<br>VKFKCPSSGTPNPTLRWLKNGKEFKPDHRIGGYKVRYATWSIIMDSVVPSDKGNYTC<br>IVENEYGSINHTYQLDVVERSPHRPILQAGLPANKTVALGSNVEFMCKVYSDPQPHI<br>QWLKHIEVNGSKIGPDNLPYVQILKTAGVNTTDKEMEVLHLRNVSFEDAGEYTCLAG<br>NSIGLSHHSAWLTVLEALEERPAVMTSPLYLEIIIYCTGAFLISCMVGSVIVYKMKS<br>GTKKSDFHSQMAVHKLAKSIPLRRQVTVSADSSASMNSGVLLVRPSRLSSSGTPMLA<br>GVSEYELPEDPRWELPRDRLVLGKPLGEGCFGQVVLAEAIGLDKDKPNRVTKVAVKM<br>LKSDATEKDLSDLISEMEMMKMIGKHKNIINLLGACTQDGPLYV**IVEYASKGNLR**EY<br>LQARRPPGLEYCYNPSHNPEEQLSSKDLVSCAYQVARGMEYLASKKCIHRDLAARNV<br>LVTEDNVMKIADFGLARDIHHIDYYKKTTNGRLPVKWMAPEALFDRIYTHQSDVWSF<br>GVLLWEIFTLGGSPYPGVPVEELFKLLKEGHRMDKPSNCTNELYMMMRDCWHAVPSQ<br>RPTFKQLVEDLDRIVALTSNQEYLDLSMPLDQYSPSFPDTRSSTCSSGEDSVFSHEP<br>LPEEPCLPRHPAQLANGGLKRR |
| SEQ ID NO: 19 | FGFR2 isoform 1 Nucleic acid sequence | GGCGGCGGCTGGAGGAGAGCGCGGTGGAGAGCCGAGCGGGCGGGCGGCGGGTGCGGA<br>GCGGGCGAGGGAGCGCGCGCGGCCGCCACAAAGCTCGGGCGCCGCGGGGCTGCATGC<br>GGCGTACCTGGCCCGGCGCGGCGACTGCTCTCCGGGCTGGCGGGGGCCGGCCGCGAG<br>CCCCGGGGGCCCCGAGGCCGCAGCTTGCCTGCGCGCTCTGAGCCTTCGCAACTCGCG<br>AGCAAAGTTTGGTGGAGGCAACGCCAAGCCTGAGTCCTTTCTTCCTCTCGTTCCCCA<br>AATCCGAGGGCAGCCCGCGGGCGTCATGCCCGCGCTCCTCCGCAGCCTGGGGTACGC<br>GTGAAGCCCGGGAGGCTTGGCGCCGGCGAAGACCCAAGGACCACTCTTCTGCGTTTG<br>GAGTTGCTCCCCGCAACCCCGGGCTCGTCGCTTTCTCCATCCCGACCCACGCGGGGC<br>GCGGGGACAACACAGGTCGCGGAGGAGCGTTGCCATTCAAGTGACTGCAGCAGCAGC<br>GGCAGCGCCTCGGTTCCTGAGCCCACCGCAGGCTGAAGGCATTGCGCGTAGTCCATG<br>CCCGTAGAGGAAGTGTGCAGATGGGATTAACGTCCACATGGAGATATGGAAGAGGAC<br>CGGGGATTGGTACCGTAACCATGGTCAGCTGGGGTCGTTTCATCTGCCTGGTCGTGG<br>TCACCATGGCAACCTTGTCCCTGGCCCGGCCCTCCTTCAGTTTAGTTGAGGATACCA<br>CATTAGAGCCAGAAGATGCCATCTCATCCGGAGATGATGAGGATGACACCGATGGTG<br>CGGAAGATTTTGTCAGTGAGAACAGTAACAACAAGAGAGCACCATACTGGACCAACA<br>CAGAAAAGATGGAAAAGCGGCTCCATGCTGTGCCTGCGGCCAACACTGTCAAGTTTC<br>GCTGCCCAGCCGGGGGGAACCCAATGCCAACCATGCGGTGGCTGAAAAACGGGAAGG<br>AGTTTAAGCAGGAGCATCGCATTGGAGGCTACAAGGTACGAAACCAGCACTGGAGCC<br>TCATTATGGAAAGTGTGGTCCCATCTGACAAGGGAAATTATACCTGTGTAGTGGAGA<br>ATGAATACGGGTCCATCAATCACACGTACCACCTGGATGTTGTGGAGCGATCGCCTC<br>ACCGGCCCATCCTCCAAGCCGGACTGCCGGCAAATGCCTCCACAGTGGTCGGAGGAG<br>ACGTAGAGTTTGTCTGCAAGGTTTACAGTGATGCCCAGCCCCACATCCAGTGGATCA<br>AGCACGTGGAAAAGAACGGCAGTAAATACGGGCCCGACGGGCTGCCCTACCTCAAGG<br>TTCTCAAGGCCGCCGGTGTTAACACCACGGACAAAGAGATTGAGGTTCTCTATATTC<br>GGAATGTAACTTTTGAGGACGCTGGGGAATATACGTGCTTGGCGGGTAATTCTATTG<br>GGATATCCTTTCACTCTGCATGGTTGACAGTTCTGCCAGCGCCTGGAAGAGAAAAGG<br>AGATTACAGCTTCCCCAGACTACCTGGAGATAGCCATTTACTGCATAGGGGTCTTCT<br>TAATCGCCTGTATGGTGGTAACAGTCATCCTGTGCCGAATGAAGAACACGACCAAGA<br>AGCCAGACTTCAGCAGCCAGCCGGCTGTGCACAAGCTGACCAAACGTATCCCCCTGC<br>GGAGACAGGTAACAGTTTCGGCTGAGTCCAGCTCCTCCATGAACTCCAACACCCCGC<br>TGGTGAGGATAACAACACGCCTCTCTTCAACGGCAGACACCCCCATGCTGGCAGGGG<br>TCTCCGAGTATGAACTTCCAGAGGACCCAAAATGGGAGTTTCCAAGAGATAAGCTGA<br>CACTGGGCAAGCCCCTGGGAGAAGGTTGCTTTGGGCAAGTGGTCATGGCGGAAGCAG<br>TGGGAATTGACAAAGACAAGCCCAAGGAGGCGGTCACCGTGGCCGTGAAGATGTTGA<br>AAGATGATGCCACAGAGAAAGACCTTTCTGATCTGGTGTCAGAGATGGAGATGATGA<br>AGATGATTGGGAAACACAAGAATATCATAAATCTTCTTGGAGCCTGCACACAGGATG<br>GGCCTCTCTATGTCATAGTTGAGTATGCCTCTAAAGGCAACCTCCGAGAATACCTCC<br>GAGCCCGGAGGCCACCCGGGATGGAGTACTCCTATGACATTAACCGTGTTCCTGAGG<br>AGCAGATGACCTTCAAGGACTTGGTGTCATGCACCTACCAGCTGGCCAGAGGCATGG<br>AGTACTTGGCTTCCCAAAAATGTATTCATCGAGATTTAGCAGCCAGAAATGTTTTGG<br>TAACAGAAAACAATGTGATGAAAATAGCAGACTTTGGACTCGCCAGAGATATCAACA<br>ATATAGACTATTACAAAAAGACCACCAATGGGCGGCTTCCAGTCAAGTGGATGGCTC<br>CAGAAGCCCTGTTTGATAGAGTATACACTCATCAGAGTGATGTCTGGTCCTTCGGGG<br>TGTTAATGTGGGAGATCTTCACTTTAGGGGGCTCGCCCTACCCAGGGATTCCCGTGG<br>AGGAACTTTTTAAGCTGCTGAAGGAAGGACACAGAATGGATAAGCCAGCCAACTGCA<br>CCAACGAACTGTACATGATGATGAGGGACTGTTGGCATGCAGTGCCCTCCCAGAGAC |

TABLE 3-continued

| FGFR sequences | | |
|---|---|---|
| | | CAACGTTCAAGCAGTTGGTAGAAGACTTGGATCGAATTCTCACTCTCACAACCAATG<br>AGGAATACTTGGACCTCAGCCAACCTCTCGAACAGTATTCACCTAGTTACCCTGACA<br>CAAGAAGTTCTTGTTCTTCAGGAGATGATTCTGTTTTTCTCCAGACCCCATGCCTT<br>ACGAACCATGCCTTCCTCAGTATCCACACATAAACGGCAGTGTTAAAACATGAATGA<br>CTGTGTCTGCCTGTCCCCAAACAGGACAGCACTGGGAACCTAGCTACACTGAGCAGG<br>GAGACCATGCCTCCCAGAGCTTGTTGTCTCCACTTGTATATATGGATCAGAGGAGTA<br>AATAATTGGAAAAGTAATCAGCATATGTGTAAAGATTTATACAGTTGAAAACTTGTA<br>ATCTTCCCCAGGAGGAGAAGAAGGTTTCTGGAGCAGTGGACTGCCACAAGCCACCAT<br>GTAACCCCTCTCACCTGCCGTGCGTACTGGCTGTGGACCAGTAGGACTCAAGGTGGA<br>CGTGCGTTCTGCCTTCCTTGTTAATTTTGTAATAATTGGAGAAGATTTATGTCAGCA<br>CACACTTACAGAGCACAAATGCAGTATATAGGTGCTGGATGTATGTAAATATATTCA<br>AATTATGTATAAATATATATTATATATTTACAAGGAGTTATTTTTTGTATTGATTTT<br>AAATGGATGTCCCAATGCACCTAGAAAATTGGTCTCTCTTTTTTTAATAGCTATTTG<br>CTAAATGCTGTTCTTACACATAATTTCTTAATTTTCACCGAGCAGAGGTGGAAAAAT<br>ACTTTTGCTTTCAGGGAAAATGGTATAACGTTAATTTATTAATAAATTGGTAATATA<br>CAAAACAATTAATCATTTATAGTTTTTTTGTAATTTAAGTGGCATTTCTATGCAGG<br>CAGCACAGCAGACTAGTTAATCTATTGCTTGGACTTAACTAGTTATCAGATCCTTTG<br>AAAAGAGAATATTTACAATATATGACTAATTTGGGGAAAATGAAGTTTTGATTTATT<br>TGTGTTTAAATGCTGCTGTCAGACGATTGTTCTTAGACCTCCTAAATGCCCCATATT<br>AAAAGAACTCATTCATAGGAAGGTGTTTCATTTTGGTGTGCAACCCTGTCATTACGT<br>CAACGCAACGTCTAACTGGACTTCCCAAGATAAATGGTACCAGCGTCCTCTTAAAAG<br>ATGCCTTAATCCATTCCTTGAGGACAGACCTTAGTTGAAATGATAGCAGAATGTGCT<br>TCTCTCTGGCAGCTGGCCTTCTGCTTCTGAGTTGCACATTAATCAGATTAGCCTGTA<br>TTCTCTTCAGTGAATTTTGATAATGGCTTCCAGACTCTTTGGCGTTGGAGACGCCTG<br>TTAGGATCTTCAAGTCCCATCATAGAAAATTGAAACACAGAGTTGTTCTGCTGATAG<br>TTTTGGGGATACGTCCATCTTTTTAAGGGATTGCTTTCATCTAATTCTGGCAGGACC<br>TCACCAAAAGATCCAGCCTCATACCTACATCAGACAAAATATCGCCGTTGTTCCTTC<br>TGTACTAAAGTATTGTGTTTTGCTTTGGAAACACCCACTCACTTTGCAATAGCCGTG<br>CAAGATGAATGCAGATTACACTGATCTTATGTGTTACAAAATTGGAGAAAGTATTTA<br>ATAAAACCTGTTAATTTTTATACTGACAATAAAAATGTTTCTACAGATATTAATGTT<br>AACAAGACAAAATAAATGTCACGCAACTTATTTTTTT |
| SEQ ID NO: 20 | FGFR2 isoform 1 Amino acid sequence | MVSWGRFICLVVVTMATLSLARPSFSLVEDTTLEPEDAISSGDDEDDTDGAEDFVSE<br>NSNNKRAPYWTNTEKMEKRLHAVPAANTVKFRCPAGGNPMPTMRWLKNGKEFKQEHR<br>IGGYKVRNQHWSLIMESVVPSDKGNYTCVVENEYGSINHTYHLDVVERSPHRPILQA<br>GLPANASTVVGGDVEFVCKVYSDAQPHIQWIKHVEKNGSKYGPDGLPYLKVLKAAGV<br>NTTDKEIEVLYIRNVTFEDAGEYTCLAGNSIGISFHSAWLTVLPAPGREKEITASPD<br>YLEIAIYCIGVFLIACMVVTVILCRMKNTTKKPDFSSQPAVHKLTKRIPLRRQVTVS<br>AESSSSMNSNTPLVRITTRLSSTADTPMLAGVSEYELPEDPKWEFPRDKLTLGKPLG<br>EGCFGQVVMAEAVGIDKDKPKEAVTVAVKMLKDDATEKDLSDLVSEMEMMKMIGKHK<br>NIINLLGACTQDGPLYV**IVEYASKGNLR**EYLRARRPPGMEYSYDINRVPEEQMTFKD<br>LVSCTYQLARGMEYLASQKCIHRDLAARNVLVTENNVMKIADFGLARDINNIDYYKK<br>TTNGRLPVKWMAPEALFDRVYTHQSDVWSFGVLMWEIFTLGGSPYPGIPVEELFKLL<br>KEGHRMDKPANCTNELYMMMRDCWHAVPSQRPTFKQLVEDLDRILTLTTNEEYLDLS<br>QPLEQYSPSYPDTRSSCSSGDDSVFSPDPMPYEPCLPQYPHINGSVKT |
| SEQ ID NO: 21 | FGFR2 isoform 2 Nucleic acid sequence | CCCAAGGACCACTCTTCTGCGTTTGGAGTTGCTCCCCGCAACCCCGGGCTCGTCGCT<br>TTCTCCATCCCGACCCACGCGGGGCGCGGGGACAACACAGGTCGCGGAGGAGCGTTG<br>CCATTCAAGTGACTGCAGCAGCAGCGGCAGCGCCTCGGTTCCTGAGCCCACCGCAGG<br>CTGAAGGCATTGCGCGTAGTCCATGCCCGTAGAGGAAGTGTGCAGATGGGATTAACG<br>TCCACATGGAGATATGGAAGAGGACCGGGGATTGGTACCGTAACCATGGTCAGCTGG<br>GGTCGTTTCATCTGCCTGGTCGTGGTCACCATGGCAACCTTGTCCCTGGCCCGGCCC<br>TCCTTCAGTTTAGTTGAGGATACCACATTAGAGCCAGAAGAGCCACCAACCAAATAC<br>CAAATCTCTCAACCAGAAGTGTACGTGGCTGCGCCAGGGGAGTCGCTAGAGGTGCGC<br>TGCCTGTTGAAAGATGCCGCCGTGATCAGTTGGACTAAGGATGGGGTGCACTTGGGG<br>CCCAACAATAGGACAGTGCTTATTGGGGAGTACTTGCAGATAAAGGGCGCCACGCCT<br>AGAGACTCCGGCCTCTATGCTTGTACTGCCAGTAGGACTGTAGACAGTGAAACTTGG<br>TACTTCATGGTGAATGTCACAGATGCCATCTCATCCGGAGATGATGAGGATGACACC<br>GATGGTGCGGAAGATTTTGTCAGTGAGAACAGTAACAACAAGAGAGCACCATACTGG<br>ACCAACACAGAAAAGATGGAAAAGCGGCTCCATGCTGTGCCTGCGGCCAACACTGTC<br>AAGTTTCGCTGCCCAGCCGGGGGGAACCCAATGCCAACCATGCGGTGGCTGAAAAAC<br>GGGAAGGAGTTTAAGCAGGAGCATCGCATTGGAGGCTACAAGGTACGAAACCAGCAC<br>TGGAGCCTCATTATGGAAAGTGTGGTCCCATCTGACAAGGGAAATTATACCTGTGTA<br>GTGGAGAATGAATACGGGTCCATCAATCACACGTACCACCTGGATGTTGTGGAGCGA<br>TCGCCTCACCGGCCCATCCTCCAAGCCGGACTGCCGGCAAATGCCTCCACAGTGGTC<br>GGAGGAGACGTAGAGTTTGTCTGCAAGGTTTACAGTGATGCCCAGCCCCACATCCAG<br>TGGATCAAGCACGTGGAAAAGAACGGCAGTAAATACGGGCCCGACGGGCTGCCCTAC<br>CTCAAGGTTCTCAAGGCCGCCGGTGTTAACACCACGGACAAAGAGATTGAGGTTCTC<br>TATATTCGGAATGTAACTTTTGAGGACGCTGGGGAATATACGTGCTTGGCGGGTAAT<br>TCTATTGGGATATCCTTTCACTCTGCATGGTTGACAGTTCTGCCAGCGCCTGGAAGA<br>GAAAAGGAGATTACAGCTTCCCCAGACTACCTGGAGATAGCCATTTACTGCATAGGG<br>GTCTTCTTAATCGCCTGTATGGTGGTAACAGTCATCCTGTGCCGAATGAAGAACACG<br>ACCAAGAAGCCAGACTTCAGCAGCCAGCCGGCTGTGCACAAGCTGACCAAACGTATC<br>CCCCTGCGGAGACAGGTAACAGTTTCGGCTGAGTCCAGCTCCTCCATGAACTCCAAC<br>ACCCCGCTGGTGAGGATAACAACACGCCTCTCTTCAACGGCAGACACCCCCATGCTG<br>GCAGGGGTCTCCGAGTATGAACTTCCAGAGGACCCAAAATGGGAGTTTCCAAGAGAT<br>AAGCTGACACTGGGCAAGCCCCTGGGAGAAGGTTGCTTTGGGCAAGTGGTCATGGCG<br>GAAGCAGTGGGAATTGACAAAGACAAGCCCAAGGAGGCGGTCACCGTGGCCGTGAAG |

TABLE 3-continued

| FGFR sequences | | |
|---|---|---|
| | | ATGTTGAAAGATGATGCCACAGAGAAAGACCTTTCTGATCTGGTGTCAGAGATGGAG<br>ATGATGAAGATGATTGGGAAACACAAGAATATCATAAATCTTCTTGGAGCCTGCACA<br>CAGGATGGGCCTCTCTATGTCATAGTTGAGTATGCCTCTAAAGGCAACCTCCGAGAA<br>TACCTCCGAGCCCGGAGGCCACCCGGGATGGAGTACTCCTATGACATTAACCGTGTT<br>CCTGAGGAGCAGATGACCTTCAAGGACTTGGTGTCATGCACCTACCAGCTGGCCAGA<br>GGCATGGAGTACTTGGCTTCCCAAAAATGTATTCATCGAGATTTAGCAGCCAGAAAT<br>GTTTTGGTAACAGAAAACAATGTGATGAAAATAGCAGACTTTGGACTCGCCAGAGAT<br>ATCAACAATATAGACTATTACAAAAAGACCACCAATGGGCGGCTTCCAGTCAAGTGG<br>ATGGCTCCAGAAGCCCTGTTTGATAGAGTATACACTCATCAGAGTGATGTCTGGTCC<br>TTCGGGGTGTTAATGTGGGAGATCTTCACTTTAGGGGGCTCGCCCTACCCAGGGATT<br>CCCGTGGAGGAACTTTTTAAGCTGCTGAAGGAAGGACACAGAATGGATAAGCCAGCC<br>AACTGCACCAACGAACTGTACATGATGATGAGGGACTGTTGGCATGCAGTGCCCTCC<br>CAGAGACCAACGTTCAAGCAGTTGGTAGAAGACTTGGATCGAATTCTCACTCTCACA<br>ACCAATGAGGAATACTTGGACCTCAGCCAACCTCTCGAACAGTATTCACCTAGTTAC<br>CCTGACACAAGAAGTTCTTGTTCTTCAGGAGATGATTCTGTTTTTTCTCCAGACCCC<br>ATGCCTTACGAACCATGCCTTCCTCAGTATCCACACATAAACGGCAGTGTTAAAACA<br>TGAATGACTGTGTCTGCCTGTCCCCAAACAGGACAGCACTGGGAACCTAGCTACACT<br>GAGCAGGGAGACCATGCCTCCCAGAGCTTGTTGTCTCCACTTGTATATATGGATCAG<br>AGGAGTAAATAATTGGAAAAGTAATCAGCATATGTGTAAAGATTTATACAGTTGAAA<br>ACTTGTAATCTTCCCCAGGAGGAGAAGAAGGTTTCTGGAGCAGTGGACTGCCACAAG<br>CCACCATGTAACCCCTCTCACCTGCCGTGCGTACTGGCTGTGGACCAGTAGGACTCA<br>AGGTGGACGTGCGTTCTGCCTTCCTTGTTAATTTTGTAATAATTGGAGAAGATTTAT<br>GTCAGCACACACTTACAGAGCACAAATGCAGTATATAGGTGCTGGATGTATGTAAAT<br>ATATTCAAATTATGTATAAATATATATTATATATTTACAAGGAGTTATTTTTTGTAT<br>TGATTTTAAATGGATGTCCCAATGCACCTAGAAAATTGGTCTCTCTTTTTTTAATAG<br>CTATTTGCTAAATGCTGTTCTTACACATAATTTCTTAATTTTCACCGAGCAGAGGTG<br>GAAAAATACTTTTGCTTTCAGGGAAAATGGTATAACGTTAATTTATTAATAAATTGG<br>TAATATACAAAACAATTAATCATTTATAGTTTTTTTTGTAATTTAAGTGGCATTTCT<br>ATGCAGGCAGCACAGCAGACTAGTTAATCTATTGCTTGGACTTAACTAGTTATCAGA<br>TCCTTTGAAAAGAGAATATTTACAATATATGACTAATTTGGGGAAAATGAAGTTTTG<br>ATTTATTTGTGTTTAAATGCTGCTGTCAGACGATTGTTCTTAGACCTCCTAAATGCC<br>CCATATTAAAAGAACTCATTCATAGGAAGGTGTTTCATTTTGGTGTGCAACCCTGTC<br>ATTACGTCAACGCAACGTCTAACTGGACTTCCCAAGATAAATGGTACCAGCGTCCTC<br>TTAAAAGATGCCTTAATCCATTCCTTGAGGACAGACCTTAGTTGAAATGATAGCAGA<br>ATGTGCTTCTCTCTGGCAGCTGGCCTTCTGCTTCTGAGTTGCACATTAATCAGATTA<br>GCCTGTATTCTCTTCAGTGAATTTTGATAATGGCTTCCAGACTCTTTGGCGTTGGAG<br>ACGCCTGTTAGGATCTTCAAGTCCCATCATAGAAAATTGAAACACAGAGTTGTTCTG<br>CTGATAGTTTTGGGGATACGTCCATCTTTTTAAGGGATTGCTTTCATCTAATTCTGG<br>CAGGACCTCACCAAAAGATCCAGCCTCATACCTACATCAGACAAAATATCGCCGTTG<br>TTCCTTCTGTACTAAAGTATTGTGTTTTGCTTTGGAAACACCCACTCACTTTGCAAT<br>AGCCGTGCAAGATGAATGCAGATTACACTGATCTTATGTGTTACAAAATTGGAGAAA<br>GTATTTAATAAAACCTGTTAATTTTTATACTGACAATAAAAATGTTTCTACAGATAT<br>TAATGTTAACAAGACAAAATAAATGTCACGCAACTTA |
| SEQ ID<br>NO: 22 | FGFR2<br>isoform 2<br>Amino acid<br>sequence | MVSWGRFICLVVVTMATLSLARPSFSLVEDTTLEPEEPPTKYQISQPEVYVAAPGES<br>LEVRCLLKDAAVISWTKDGVHLGPNNRTVLIGEYLQIKGATPRDSGLYACTASRTVD<br>SETWYFMVNVTDAISSGDDEDDTDGAEDFVSENSNNKRAPYWTNTEKMEKRLHAVPA<br>ANTVKFRCPAGGNPMPTMRWLKNGKEFKQEHRIGGYKVRNQHWSLIMESVVPSDKGN<br>YTCVVENEYGSINHTYHLDVVERSPHRPILQAGLPANASTVVGGDVEFVCKVYSDAQ<br>PHIQWIKHVEKNGSKYGPDGLPYLKVLKAAGVNTTDKEIEVLYIRNVTFEDAGEYTC<br>LAGNSIGISFHSAWLTVLPAPGREKEITASPDYLEIAIYCIGVFLIACMVVTVILCR<br>MKNTTKKPDFSSQPAVHKLTKRIPLRRQVTVSAESSSSMNSNTPLVRITTRLSSTAD<br>TPMLAGVSEYELPEDPKWEFPRDKLTLGKPLGEGCFGQVVMAEAVGIDKDKPKEAVT<br>VAVKMLKDDATEKDLSDLVSEMEMMKMIGKHKNIINLLGACTQDGPLYV**IVEYASKG**<br>**NLR**EYLRARRPPGMEYSYDINRVPEEQMTFKDLVSCTYQLARGMEYLASQKCIHRDL<br>AARNVLVTENNVMKIADFGLARDINNIDYYKKTTNGRLPVKWMAPEALFDRVYTHQS<br>DVWSFGVLMWEIFTLGGSPYPGIPVEELFKLLKEGHRMDKPANCTNELYMMMRDCWH<br>AVPSQRPTFKQLVEDLDRILTLTTNEEYLDLSQPLEQYSPSYPDTRSSCSSGDDSVF<br>SPDPMPYEPCLPQYPHINGSVKT |
| SEQ ID<br>NO: 23 | FGFR2<br>isoform 3<br>Nucleic acid<br>sequence | ACAGACTCTCCCGCAGAACTGACCCCAGCAAGAAGCCTTTGGGAGCAGTAGAGATGG<br>AGTTTCACTATGTTGCCCAGGCTAGCCTTGAACTCCTGACCTCAGATGATCTGCCCG<br>CGCAGGCCTCCCGAAGTGCTGGGATTACAGGCATGAGCCACCGCACCTGGCCTGCCA<br>ACTCTTGTTAAGATCTCGAAGGAAACATTTTCTTCCCCTGAAGGAAACCCAGCTATG<br>CAGACACCAGCTGATAATCTTGCATTCCTGAAAGATGTTGCACCCCTATGGCAAGTG<br>GCGGCTGCTGAGGCTCTGACGTGACTCCCAGGCATGAACGCTCTCAGCTGTGTTTAC<br>CTCAGCTCCTCGGGAGGGAGCCTGGGAGACTGACGCCTGAGTTTTACATCAGTGTCA<br>AAACCCAAGCACAACCTAGGGAGGGACCTCCTGCCTAGTGTGTGTGGGTCAGGAGAT<br>AGAAAAGCTCTCACTGAGTAAACTGGACAAGGTCAATATACCTCGCTGATTGAGAAG<br>ACTTCACTCTCTCTGCAAAGAGACGTGTGTGTTTTAGAGGAAGTGGGAGCCCCAGCC<br>GATTCTGCAAGACTTCCGAGAGTCAGATATCCAGACAGAAGATGCGGACACCTGGGT<br>GACCAGACAGCGAAGAGGAAAGAACAAAACGAGCATGTGCCAAGCCTGTGAGGGAGA<br>AAGGGCAACAAACCAGTGACCTTCCACAGAAATGTGTTTAAACAAAACAAAACAGCT<br>CTTTGGCGTTGCTAAGAGACTGCCATTTTGGAGGAAAGAGCGATCGCCTCACCGGCC<br>CATCCTCCAAGCCGGACTGCCGGCAAATGCCTCCACAGTGGTCGGAGGAGACGTAGA<br>GTTTGTCTGCAAGGTTTACAGTGATGCCCAGCCCCACATCCAGTGGATCAAGCACGT<br>GGAAAAGAACGGCAGTAAATACGGGCCCGACGGGCTGCCCTACCTCAAGGTTCTCAA<br>GGCCGCCGGTGTTAACACCACGGACAAAGAGATTGAGGTTCTCTATATTCGGAATGT |

TABLE 3-continued

| FGFR sequences | | |
|---|---|---|
| | | AACTTTTGAGGACGCTGGGGAATATACGTGCTTGGCGGGTAATTCTATTGGGATATC<br>CTTTCACTCTGCATGGTTGACAGTTCTGCCAGCGCCTGGAAGAGAAAAGGAGATTAC<br>AGCTTCCCCAGACTACCTGGAGATAGCCATTTACTGCATAGGGGTCTTCTTAATCGC<br>CTGTATGGTGGTAACAGTCATCCTGTGCCGAATGAAGAACACGACCAAGAAGCCAGA<br>CTTCAGCAGCCAGCCGGCTGTGCACAAGCTGACCAAACGTATCCCCCTGCGGAGACA<br>GGTAACAGTTTCGGCTGAGTCCAGCTCCTCCATGAACTCCAACACCCCGCTGGTGAG<br>GATAACAACACGCCTCTCTTCAACGGCAGACACCCCCATGCTGGCAGGGGTCTCCGA<br>GTATGAACTTCCAGAGGACCCAAAATGGGAGTTTCCAAGAGATAAGCTGACACTGGG<br>CAAGCCCCTGGGAGAAGGTTGCTTTGGGCAAGTGGTCATGGCGGAAGCAGTGGGAAT<br>TGACAAAGACAAGCCCAAGGAGGCGGTCACCGTGGCCGTGAAGATGTTGAAAGATGA<br>TGCCACAGAGAAAGACCTTTCTGATCTGGTGTCAGAGATGGAGATGATGAAGATGAT<br>TGGGAAACACAAGAATATCATAAATCTTCTTGGAGCCTGCACACAGGATGGGCCTCT<br>CTATGTCATAGTTGAGTATGCCTCTAAAGGCAACCTCCGAGAATACCTCCGAGCCCG<br>GAGGCCACCCGGGATGGAGTACTCCTATGACATTAACCGTGTTCCTGAGGAGCAGAT<br>GACCTTCAAGGACTTGGTGTCATGCACCTACCAGCTGGCCAGAGGCATGGAGTACTT<br>GGCTTCCCAAAAATGTATTCATCGAGATTTAGCAGCCAGAAATGTTTTGGTAACAGA<br>AAACAATGTGATGAAAATAGCAGACTTTGGACTCGCCAGAGATATCAACAATATAGA<br>CTATTACAAAAAGACCACCAATGGGCGGCTTCCAGTCAAGTGGATGGCTCCAGAAGC<br>CCTGTTTGATAGAGTATACACTCATCAGAGTGATGTCTGGTCCTTCGGGGTGTTAAT<br>GTGGGAGATCTTCACTTTAGGGGGCTCGCCCTACCCAGGGATTCCCGTGGAGGAACT<br>TTTTAAGCTGCTGAAGGAAGGACACAGAATGGATAAGCCAGCCAACTGCACCAACGA<br>ACTGTACATGATGATGAGGGACTGTTGGCATGCAGTGCCCTCCCAGAGACCAACGTT<br>CAAGCAGTTGGTAGAAGACTTGGATCGAATTCTCACTCTCACAACCAATGAGGAATA<br>CTTGGACCTCAGCCAACCTCTCGAACAGTATTCACCTAGTTACCCTGACACAAGAAG<br>TTCTTGTTCTTCAGGAGATGATTCTGTTTTTCTCCAGACCCCATGCCTTACGAACC<br>ATGCCTTCCTCAGTATCCACACATAAACGGCAGTGTTAAAACATGAATGACTGTGTC<br>TGCCTGTCCCCAAACAGGACAGCACTGGGAACCTAGCTACACTGAGCAGGGAGACCA<br>TGCCTCCCAGAGCTTGTTGTCTCCACTTGTATATATGGATCAGAGGAGTAAATAATT<br>GGAAAAGTAATCAGCATATGTGTAAAGATTTATACAGTTGAAAACTTGTAATCTTCC<br>CCAGGAGGAGAAGAAGGTTTCTGGAGCAGTGGACTGCCACAAGCCACCATGTAACCC<br>CTCTCACCTGCCGTGCGTACTGGCTGTGGACCAGTAGGACTCAAGGTGGACGTGCGT<br>TCTGCCTTCCTTGTTAATTTTGTAATAATTGGAGAAGATTTATGTCAGCACACACTT<br>ACAGAGCACAAATGCAGTATATAGGTGCTGGATGTATGTAAATATATTCAAATTATG<br>TATAAATATATATTATATATTTACAAGGAGTTATTTTTTGTATTGATTTTAAATGGA<br>TGTCCCAATGCACCTAGAAAATTGGTCTCTCTTTTTTTAATAGCTATTTGCTAAATG<br>CTGTTCTTACACATAATTTCTTAATTTTCACCGAGCAGAGGTGGAAAAATACTTTTG<br>CTTTCAGGGAAAATGGTATAACGTTAATTTATTAATAAATTGGTAATATACAAAACA<br>ATTAATCATTTATAGTTTTTTTTGTAATTTAAGTGGCATTTCTATGCAGGCAGCACA<br>GCAGACTAGTTAATCTATTGCTTGGACTTAACTAGTTATCAGATCCTTTGAAAAGAG<br>AATATTTACAATATATGACTAATTTGGGGAAAATGAAGTTTTGATTTATTTGTGTTT<br>AAATGCTGCTGTCAGACGATTGTTCTTAGACCTCCTAAATGCCCCATATTAAAAGAA<br>CTCATTCATAGGAAGGTGTTTCATTTTGGTGTGCAACCCTGTCATTACGTCAACGCA<br>ACGTCTAACTGGACTTCCCAAGATAAATGGTACCAGCGTCCTCTTAAAAGATGCCTT<br>AATCCATTCCTTGAGGACAGACCTTAGTTGAAATGATAGCAGAATGTGCTTCTCTCT<br>GGCAGCTGGCCTTCTGCTTCTGAGTTGCACATTAATCAGATTAGCCTGTATTCTCTT<br>CAGTGAATTTTGATAATGGCTTCCAGACTCTTTGGCGTTGGAGACGCCTGTTAGGAT<br>CTTCAAGTCCCATCATAGAAAATTGAAACACAGAGTTGTTCTGCTGATAGTTTTGGG<br>GATACGTCCATCTTTTTAAGGGATTGCTTTCATCTAATTCTGGCAGGACCTCACCAA<br>AAGATCCAGCCTCATACCTACATCAGACAAAATATCGCCGTTGTTCCTTCTGTACTA<br>AAGTATTGTGTTTTGCTTTGGAAACACCCACTCACTTTGCAATAGCCGTGCAAGATG<br>AATGCAGATTACACTGATCTTATGTGTTACAAAATTGGAGAAAGTATTTAATAAAAC<br>CTGTTAATTTTTATACTGACAATAAAAATGTTTCTACAGATATTAATGTTAACAAGA |
| SEQ ID NO: 24 | FGFR2 isoform 3 Amino acid sequence | MCLNKTKQLFGVAKRLPFWRKERSPHRPILQAGLPANASTVVGGDVEFVCKVYSDAQ<br>PHIQWIKHVEKNGSKYGPDGLPYLKVLKAAGVNTTDKEIEVLYIRNVTFEDAGEYTC<br>LAGNSIGISFHSAWLTVLPAPGREKEITASPDYLEIAIYCIGVFLIACMVVTVILCR<br>MKNTTKKPDFSSQPAVHKLTKRIPLRRQVTVSAESSSSMNSNTPLVRITTRLSSTAD<br>TPMLAGVSEYELPEDPKWEFPRDKLTLGKPLGEGCFGQVVMAEAVGIDKDKPKEAVT<br>VAVKMLKDDATEKDLSDLVSEMEMMKMIGKHKNIINLLGACTQDGPLYV**IVEYASKG**<br>**NLR**EYLRARRPPGMEYSYDINRVPEEQMTFKDLVSCTYQLARGMEYLASQKCIHRDL<br>AARNVLVTENNVMKIADFGLARDINNIDYYKKTTNGRLPVKWMAPEALFDRVYTHQS<br>DVWSFGVLMWEIFTLGGSPYPGIPVEELFKLLKEGHRMDKPANCTNELYMMMRDCWH<br>AVPSQRPTFKQLVEDLDRILTLTTNEEYLDLSQPLEQYSPSYPDTRSSCSSGDDSVF<br>SPDPMPYEPCLPQYPHINGSVKT |
| SEQ ID NO: 25 | FGFR2 isoform 4 Nucleic acid sequence | TGACTGCAGCAGCAGCGGCAGCGCCTCGGTTCCTGAGCCCACCGCAGGCTGAAGGCA<br>TTGCGCGTAGTCCATGCCCGTAGAGGAAGTGTGCAGATGGGATTAACGTCCACATGG<br>AGATATGGAAGAGGACCGGGGATTGGTACCGTAACCATGGTCAGCTGGGGTCGTTTC<br>ATCTGCCTGGTCGTGGTCACCATGGCAACCTTGTCCCTGGCCCGGCCCTCCTTCAGT<br>TTAGTTGAGGATACCACATTAGAGCCAGAAGAGCCACCAACCAAATACCAAATCTCT<br>CAACCAGAAGTGTACGTGGCTGCGCCAGGGGAGTCGCTAGAGGTGCGCTGCCTGTTG<br>AAAGATGCCGCCGTGATCAGTTGGACTAAGGATGGGGTGCACTTGGGGCCCAACAAT<br>AGGACAGTGCTTATTGGGGAGTACTTGCAGATAAAGGGCGCCACGCCTAGAGACTCC<br>GGCCTCTATGCTTGTACTGCCAGTAGGACTGTAGACAGTGAAACTTGGTACTTCATG<br>GTGAATGTCACAGATGCCATCTCATCCGGAGATGATGAGGATGACACCGATGGTGCG<br>GAAGATTTTGTCAGTGAGAACAGTAACAACAAGAGAGCACCATACTGGACCAACACA<br>GAAAAGATGGAAAAGCGGCTCCATGCTGTGCCTGCGGCCAACACTGTCAAGTTTCGC<br>TGCCCAGCCGGGGGGAACCCAATGCCAACCATGCGGTGGCTGAAAAACGGGAAGGAG |

TABLE 3-continued

| FGFR sequences | | |
| --- | --- | --- |
| | | TTTAAGCAGGAGCATCGCATTGGAGGCTACAAGGTACGAAACCAGCACTGGAGCCTC<br>ATTATGGAAAGTGTGGTCCCATCTGACAAGGGAAATTATACCTGTGTAGTGGAGAAT<br>GAATACGGGTCCATCAATCACACGTACCACCTGGATGTTGTGGCGCCTGGAAGAGAA<br>AAGGAGATTACAGCTTCCCCAGACTACCTGGAGATAGCCATTTACTGCATAGGGGTC<br>TTCTTAATCGCCTGTATGGTGGTAACAGTCATCCTGTGCCGAATGAAGAACACGACC<br>AAGAAGCCAGACTTCAGCAGCCAGCCGGCTGTGCACAAGCTGACCAAACGTATCCCC<br>CTGCGGAGACAGGTAACAGTTTCGGCTGAGTCCAGCTCCTCCATGAACTCCAACACC<br>CCGCTGGTGAGGATAACAACACGCCTCTCTTCAACGGCAGACACCCCCATGCTGGCA<br>GGGGTCTCCGAGTATGAACTTCCAGAGGACCCAAAATGGGAGTTTCCAAGAGATAAG<br>CTGACACTGGGCAAGCCCCTGGGAGAAGGTTGCTTTGGGCAAGTGGTCATGGCGGAA<br>GCAGTGGGAATTGACAAAGACAAGCCCAAGGAGGCGGTCACCGTGGCCGTGAAGATG<br>TTGAAAGATGATGCCACAGAGAAAGACCTTTCTGATCTGGTGTCAGAGATGGAGATG<br>ATGAAGATGATTGGGAAACACAAGAATATCATAAATCTTCTTGGAGCCTGCACACAG<br>GATGGGCCTCTCTATGTCATAGTTGAGTATGCCTCTAAAGGCAACCTCCGAGAATAC<br>CTCCGAGCCCGGAGGCCACCCGGGATGGAGTACTCCTATGACATTAACCGTGTTCCT<br>GAGGAGCAGATGACCTTCAAGGACTTGGTGTCATGCACCTACCAGCTGGCCAGAGGC<br>ATGGAGTACTTGGCTTCCCAAAAATGTATTCATCGAGATTTAGCAGCCAGAAATGTT<br>TTGGTAACAGAAAACAATGTGATGAAAATAGCAGACTTTGGACTCGCCAGAGATATC<br>AACAATATAGACTATTACAAAAAGACCACCAATGGGCGGCTTCCAGTCAAGTGGATG<br>GCTCCAGAAGCCCTGTTTGATAGAGTATACACTCATCAGAGTGATGTCTGGTCCTTC<br>GGGGTGTTAATGTGGGAGATCTTCACTTTAGGGGGCTCGCCCTACCCAGGGATTCCC<br>GTGGAGGAACTTTTTAAGCTGCTGAAGGAAGGACACAGAATGGATAAGCCAGCCAAC<br>TGCACCAACGAACTGTACATGATGATGAGGGACTGTTGGCATGCAGTGCCCTCCCAG<br>AGACCAACGTTCAAGCAGTTGGTAGAAGACTTGGATCGAATTCTCACTCTCACAACC<br>AATGAGGAATACTTGGACCTCAGCCAACCTCTCGAACAGTATTCACCTAGTTACCCT<br>GACACAAGAAGTTCTTGTTCTTCAGGAGATGATTCTGTTTTTTCTCCAGACCCCATG<br>CCTTACGAACCATGCCTTCCTCAGTATCCACACATAAACGGCAGTGTTAAAACATGA<br>ATGACTGTGTCTGCCTGTCCCCAAACAGGACAGCACTGGGAACCTAGCTACACTGAG<br>CAGGGAGACCATGCCTCCCAGAGCTTGTTGTCTCCACTTGTATATATGGATCAGAGG<br>AGTAAATAATTGGAAAAGTAATCAGCATATGTGTAAAGATTTATACAGTTGAAAACT<br>TGTAATCTTCCCCAGGAGGAGAAGAAGGTTTCTGGAGCAGTGGACTGCCACAAGCCA<br>CCATGTAACCCCTCTCACCTGCCGTGCGTACTGGCTGTGGACCAGTAGGACTCAAGG<br>TGGACGTGCGTTCTGCCTTCCTTGTTAATTTTGTAATAATTGGAGAAGATTTATGTC<br>AGCACACACTTACAGAGCACAAATGCAGTATATAGGTGCTGGATGTATGTAAATATA<br>TTCAAATTATGTATAAATATATATTATATATTTACAAGGAGTTATTTTTTGTATTGA<br>TTTTAAATGGATGTCCCAATGCACCTAGAAAATTGGTCTCTCTTTTTTTAATAGCTA<br>TTTGCTAAATGCTGTTCTTACACATAATTTCTTAATTTTCACCGAGCAGAGGTGGAA<br>AAATACTTTTGCTTTCAGGGAAAATGGTATAACGTTAATTTATTAATAAATTGGTAA<br>TATACAAAACAATTAATCATTTATAGTTTTTTTTGTAATTTAAGTGGCATTTCTATG<br>CAGGCAGCACAGCAGACTAGTTAATCTATTGCTTGGACTTAACTAGTTATCAGATCC<br>TTTGAAAAGAGAATATTTACAATATATGACTAATTTGGGGAAAATGAAGTTTTGATT<br>TATTTGTGTTTAAATGCTGCTGTCAGACGATTGTTCTTAGACCTCCTAAATGCCCCA<br>TATTAAAAGAACTCATTCATAGGAAGGTGTTTCATTTTGGTGTGCAACCCTGTCATT<br>ACGTCAACGCAACGTCTAACTGGACTTCCCAAGATAAATGGTACCAGCGTCCTCTTA<br>AAAGATGCCTTAATCCATTCCTTGAGGACAGACCTTAGTTGAAATGATAGCAGAATG<br>TGCTTCTCTCTGGCAGCTGGCCTTCTGCTTCTGAGTTGCACATTAATCAGATTAGCC<br>TGTATTCTCTTCAGTGAATTTTGATAATGGCTTCCAGACTCTTTGGCGTTGGAGACG<br>CCTGTTAGGATCTTCAAGTCCCATCATAGAAAATTGAAACACAGAGTTGTTCTGCTG<br>ATAGTTTTGGGGATACGTCCATCTTTTTAAGGGATTGCTTTCATCTAATTCTGGCAG<br>GACCTCACCAAAAGATCCAGCCTCATACCTACATCAGACAAAATATCGCCGTTGTTC<br>CTTCTGTACTAAAGTATTGTGTTTTGCTTTGGAAACACCCACTCACTTTGCAATAGC<br>CGTGCAAGATGAATGCAGATTACACTGATCTTATGTGTTACAAAATTGGAGAAAGTA<br>TTTAATAAAACCTGTTAATTTTTATACTGACAATAAAAATGTTTCTACAGATATTAA<br>TGTTAACAAGACAAAATAAATGTCACGCAACTTATTTTTTT |
| SEQ ID NO: 26 | FGFR2 isoform 4 Amino acid sequence | MVSWGRFICLVVVTMATLSLARPSFSLVEDTTLEPEEPPTKYQISQPEVYVAAPGES<br>LEVRCLLKDAAVISWTKDGVHLGPNNRTVLIGEYLQIKGATPRDSGLYACTASRTVD<br>SETWYFMVNVTDAISSGDDEDDTDGAEDFVSENSNNKRAPYWTNTEKMEKRLHAVPA<br>ANTVKFRCPAGGNPMPTMRWLKNGKEFKQEHRIGGYKVRNQHWSLIMESVVPSDKGN<br>YTCVVENEYGSINHTYHLDVVAPGREKEITASPDYLEIAIYCIGVFLIACMVVTVIL<br>CRMKNTTKKPDFSSQPAVHKLTKRIPLRRQVTVSAESSSSMNSNTPLVRITTRLSST<br>ADTPMLAGVSEYELPEDPKWEFPRDKLTLGKPLGEGCFGQVVMAEAVGIDKDKPKEA<br>VTVAVKMLKDDATEKDLSDLVSEMEMMKMIGKHKNIINLLGACTQDGPLYV**IVEYAS**<br>**KGNLR**EYLRARRPPGMEYSYDINRVPEEQMTFKDLVSCTYQLARGMEYLASQKCIHR<br>DLAARNVLVTENNVMKIADFGLARDINNIDYYKKTTNGRLPVKWMAPEALFDRVYTH<br>QSDVWSFGVLMWEIFTLGGSPYPGIPVEELFKLLKEGHRMDKPANCTNELYMMMRDC<br>WHAVPSQRPTFKQLVEDLDRILTLTTNEEYLDLSQPLEQYSPSYPDTRSSCSSGDDS<br>VFSPDPMPYEPCLPQYPHINGSVKT |
| SEQ ID NO: 27 | FGFR2 isoform 5 Nucleic acid sequence | AATTTGTTGAGGAATTTCCCCCTAGCCTTGACCCCTTGACAGCTCCCGCTCCTACTC<br>AGTGCTGGGGAGAAGTAGGGAGGCCTTAAGCGAAGAGATGGGTCTGCACTTTGGAGG<br>AGCCGGACACTGTTGACTTTCCTGATGTGAAATCTACCCAGGAACAAAACACCAGTG<br>ACTGCAGCAGCAGCGGCAGCGCCTCGGTTCCTGAGCCCACCGCAGGCTGAAGGCATT<br>GCGCGTAGTCCATGCCCGTAGAGGAAGTGTGCAGATGGGATTAACGTCCACATGGAG<br>ATATGGAAGAGGACCGGGGATTGGTACCGTAACCATGGTCAGCTGGGGTCGTTTCAT<br>CTGCCTGGTCGTGGTCACCATGGCAACCTTGTCCCTGGCCCGGCCCTCCTTCAGTTT<br>AGTTGAGGATACCACATTAGAGCCAGAAGATGCCATCTCATCCGGAGATGATGAGGA<br>TGACACCGATGGTGCGGAAGATTTTGTCAGTGAGAACAGTAACAACAAGAGAGCACC |

TABLE 3-continued

| FGFR sequences | | |
|---|---|---|
| | | ATACTGGACCAACACAGAAAAGATGGAAAAGCGGCTCCATGCTGTGCCTGCGGCCAA<br>CACTGTCAAGTTTCGCTGCCCAGCCGGGGGGAACCCAATGCCAACCATGCGGTGGCT<br>GAAAAACGGGAAGGAGTTTAAGCAGGAGCATCGCATTGGAGGCTACAAGGTACGAAA<br>CCAGCACTGGAGCCTCATTATGGAAAGTGTGGTCCCATCTGACAAGGGAAATTATAC<br>CTGTGTAGTGGAGAATGAATACGGGTCCATCAATCACACGTACCACCTGGATGTTGT<br>GGAGCGATCGCCTCACCGGCCCATCCTCCAAGCCGGACTGCCGGCAAATGCCTCCAC<br>AGTGGTCGGAGGAGACGTAGAGTTTGTCTGCAAGGTTTACAGTGATGCCCAGCCCCA<br>CATCCAGTGGATCAAGCACGTGGAAAAGAACGGCAGTAAATACGGGCCCGACGGGCT<br>GCCCTACCTCAAGGTTCTCAAGGCCGCCGGTGTTAACACCACGGACAAAGAGATTGA<br>GGTTCTCTATATTCGGAATGTAACTTTTGAGGACGCTGGGGAATATACGTGCTTGGC<br>GGGTAATTCTATTGGGATATCCTTTCACTCTGCATGGTTGACAGTTCTGCCAGCGCC<br>TGGAAGAGAAAAGGAGATTACAGCTTCCCCAGACTACCTGGAGATAGCCATTTACTG<br>CATAGGGGTCTTCTTAATCGCCTGTATGGTGGTAACAGTCATCCTGTGCCGAATGAA<br>GAACACGACCAAGAAGCCAGACTTCAGCAGCCAGCCGGCTGTGCACAAGCTGACCAA<br>ACGTATCCCCCTGCGGAGACAGGTAACAGTTTCGGCTGAGTCCAGCTCCTCCATGAA<br>CTCCAACACCCCGCTGGTGAGGATAACAACACGCCTCTCTTCAACGGCAGACACCCC<br>CATGCTGGCAGGGGTCTCCGAGTATGAACTTCCAGAGGACCCAAAATGGGAGTTTCC<br>AAGAGATAAGCTGACACTGGGCAAGCCCCTGGGAGAAGGTTGCTTTGGGCAAGTGGT<br>CATGGCGGAAGCAGTGGGAATTGACAAAGACAAGCCCAAGGAGGCGGTCACCGTGGC<br>CGTGAAGATGTTGAAAGATGATGCCACAGAGAAAGACCTTTCTGATCTGGTGTCAGA<br>GATGGAGATGATGAAGATGATTGGGAAACACAAGAATATCATAAATCTTCTTGGAGC<br>CTGCACACAGGATGGGCCTCTCTATGTCATAGTTGAGTATGCCTCTAAAGGCAACCT<br>CCGAGAATACCTCCGAGCCCGGAGGCCACCCGGGATGGAGTACTCCTATGACATTAA<br>CCGTGTTCCTGAGGAGCAGATGACCTTCAAGGACTTGGTGTCATGCACCTACCAGCT<br>GGCCAGAGGCATGGAGTACTTGGCTTCCCAAAAATGTATTCATCGAGATTTAGCAGC<br>CAGAAATGTTTTGGTAACAGAAAACAATGTGATGAAAATAGCAGACTTTGGACTCGC<br>CAGAGATATCAACAATATAGACTATTACAAAAAGACCACCAATGGGCGGCTTCCAGT<br>CAAGTGGATGGCTCCAGAAGCCCTGTTTGATAGAGTATACACTCATCAGAGTGATGT<br>CTGGTCCTTCGGGGTGTTAATGTGGGAGATCTTCACTTTAGGGGGCTCGCCCTACCC<br>AGGGATTCCCGTGGAGGAACTTTTTAAGCTGCTGAAGGAAGGACACAGAATGGATAA<br>GCCAGCCAACTGCACCAACGAACTGTACATGATGATGAGGGACTGTTGGCATGCAGT<br>GCCCTCCCAGAGACCAACGTTCAAGCAGTTGGTAGAAGACTTGGATCGAATTCTCAC<br>TCTCACAACCAATGAGGAGGAGAAGAAGGTTTCTGGAGCAGTGGACTGCCACAAGCC<br>ACCATGTAACCCCTCTCACCTGCCGTGCGTACTGGCTGTGGACCAGTAGGACTCAAG<br>GTGGACGTGCGTTCTGCCTTCCTTGTTAATTTTGTAATAATTGGAGAAGATTTATGT<br>CAGCACACACTTACAGAGCACAAATGCAGTATATAGGTGCTGGATGTATGTAAATAT<br>ATTCAAATTATGTATAAATATATATTATATATTTACAAGGAGTTATTTTTTGTATTG<br>ATTTTAAATGGATGTCCCAATGCACCTAGAAAATTGGTCTCTCTTTTTTTAATAGCT<br>ATTTGCTAAATGCTGTTCTTACACATAATTTCTTAATTTTCACCGAGCAGAGGTGGA<br>AAAATACTTTTGCTTTCAGGGAAAATGGTATAACGTTAATTTATTAATAAATTGGTA<br>ATATACAAAACAATTAATCATTTATAGTTTTTTTTGTAATTTAAGTGGCATTTCTAT<br>GCAGGCAGCACAGCAGACTAGTTAATCTATTGCTTGGACTTAACTAGTTATCAGATC<br>CTTTGAAAAGAGAATATTTACAATATATGACTAATTTGGGGAAAATGAAGTTTTGAT<br>TTATTTGTGTTTAAATGCTGCTGTCAGACGATTGTTCTTAGACCTCCTAAATGCCCC<br>ATATTAAAAGAACTCATTCATAGGAAGGTGTTTCATTTTGGTGTGCAACCCTGTCAT<br>TACGTCAACGCAACGTCTAACTGGACTTCCCAAGATAAATGGTACCAGCGTCCTCTT<br>AAAAGATGCCTTAATCCATTCCTTGAGGACAGACCTTAGTTGAAATGATAGCAGAAT<br>GTGCTTCTCTCTGGCAGCTGGCCTTCTGCTTCTGAGTTGCACATTAATCAGATTAGC<br>CTGTATTCTCTTCAGTGAATTTTGATAATGGCTTCCAGACTCTTTGGCGTTGGAGAC<br>GCCTGTTAGGATCTTCAAGTCCCATCATAGAAAATTGAAACACAGAGTTGTTCTGCT<br>GATAGTTTTGGGGATACGTCCATCTTTTTAAGGGATTGCTTTCATCTAATTCTGGCA<br>GGACCTCACCAAAAGATCCAGCCTCATACCTACATCAGACAAAATATCGCCGTTGTT<br>CCTTCTGTACTAAAGTATTGTGTTTTGCTTTGGAAACACCCACTCACTTTGCAATAG<br>CCGTGCAAGATGAATGCAGATTACACTGATCTTATGTGTTACAAAATTGGAGAAAGT<br>ATTTAATAAAACCTGTTAATTTTTATACTGACAATAAAAATGTTTCTACAGATATTA<br>ATGTTAACAAGACAAAATAAATGTCACGCAACTTATTTTTTT |
| SEQ ID NO: 28 | FGFR2 isoform 5 Amino acid sequence | MVSWGRFICLVVVTMATLSLARPSFSLVEDTTLEPEDAISSGDDEDDTDGAEDFVSE<br>NSNNKRAPYWTNTEKMEKRLHAVPAANTVKFRCPAGGNPMPTMRWLKNGKEFKQEHR<br>IGGYKVRNQHWSLIMESVVPSDKGNYTCVVENEYGSINHTYHLDVVERSPHRPILQA<br>GLPANASTVVGGDVEFVCKVYSDAQPHIQWIKHVEKNGSKYGPDGLPYLKVLKAAGV<br>NTTDKEIEVLYIRNVTFEDAGEYTCLAGNSIGISFHSAWLTVLPAPGREKEITASPD<br>YLEIAIYCIGVFLIACMVVTVILCRMKNTTKKPDFSSQPAVHKLTKRIPLRRQVTVS<br>AESSSSMNSNTPLVRITTRLSSTADTPMLAGVSEYELPEDPKWEFPRDKLTLGKPLG<br>EGCFGQVVMAEAVGIDKDKPKEAVTVAVKMLKDDATEKDLSDLVSEMEMMKMIGKHK<br>NIINLLGACTQDGPLYV**IVEYASKGNLR**EYLRARRPPGMEYSYDINRVPEEQMTFKD<br>LVSCTYQLARGMEYLASQKCIHRDLAARNVLVTENNVMKIADFGLARDINNIDYYKK<br>TTNGRLPVKWMAPEALFDRVYTHQSDVWSFGVLMWEIFTLGGSPYPGIPVEELFKLL<br>KEGHRMDKPANCTNELYMMMRDCWHAVPSQRPTFKQLVEDLDRILTLTTNEEEKKVS<br>GAVDCHKPPCNPSHLPCVLAVDQ |
| SEQ ID NO: 29 | FGFR2 isoform 6 Nucleic acid sequence | GGCGGCGGCTGGAGGAGAGCGCGGTGGAGAGCCGAGCGGGCGGGCGGCGGGTGCGGA<br>GCGGGCGAGGGAGCGCGCGCGGCCGCCACAAAGCTCGGGCGCCGCGGGGCTGCATGC<br>GGCGTACCTGGCCCGGCGCGGCGACTGCTCTCCGGGCTGGCGGGGGCCGGCCGCGAG<br>CCCCGGGGGCCCCGAGGCCGCAGCTTGCCTGCGCGCTCTGAGCCTTCGCAACTCGCG<br>AGCAAAGTTTGGTGGAGGCAACGCCAAGCCTGAGTCCTTTCTTCCTCTCGTTCCCCA<br>AATCCGAGGGCAGCCCGCGGGCGTCATGCCCGCGCTCCTCCGCAGCCTGGGGTACGC<br>GTGAAGCCCGGGAGGCTTGGCGCCGGCGAAGACCCAAGGACCACTCTTCTGCGTTTG |

TABLE 3-continued

| FGFR sequences | | |
|---|---|---|
| | | GAGTTGCTCCCCGCAACCCCGGGCTCGTCGCTTTCTCCATCCCGACCCACGCGGGGC<br>GCGGGGACAACACAGGTCGCGGAGGAGCGTTGCCATTCAAGTGACTGCAGCAGCAGC<br>GGCAGCGCCTCGGTTCCTGAGCCCACCGCAGGCTGAAGGCATTGCGCGTAGTCCATG<br>CCCGTAGAGGAAGTGTGCAGATGGGATTAACGTCCACATGGAGATATGGAAGAGGAC<br>CGGGGATTGGTACCGTAACCATGGTCAGCTGGGGTCGTTTCATCTGCCTGGTCGTGG<br>TCACCATGGCAACCTTGTCCCTGGCCCGGCCCTCCTTCAGTTTAGTTGAGGATACCA<br>CATTAGAGCCAGAAGGAGCACCATACTGGACCAACACAGAAAAGATGGAAAAGCGGC<br>TCCATGCTGTGCCTGCGGCCAACACTGTCAAGTTTCGCTGCCCAGCCGGGGGGAACC<br>CAATGCCAACCATGCGGTGGCTGAAAAACGGGAAGGAGTTTAAGCAGGAGCATCGCA<br>TTGGAGGCTACAAGGTACGAAACCAGCACTGGAGCCTCATTATGGAAAGTGTGGTCC<br>CATCTGACAAGGGAAATTATACCTGTGTAGTGGAGAATGAATACGGGTCCATCAATC<br>ACACGTACCACCTGGATGTTGTGGAGCGATCGCCTCACCGGCCCATCCTCCAAGCCG<br>GACTGCCGGCAAATGCCTCCACAGTGGTCGGAGGAGACGTAGAGTTTGTCTGCAAGG<br>TTTACAGTGATGCCCAGCCCCACATCCAGTGGATCAAGCACGTGGAAAAGAACGGCA<br>GTAAATACGGGCCCGACGGGCTGCCCTACCTCAAGGTTCTCAAGGCCGCCGGTGTTA<br>ACACCACGGACAAAGAGATTGAGGTTCTCTATATTCGGAATGTAACTTTTGAGGACG<br>CTGGGGAATATACGTGCTTGGCGGGTAATTCTATTGGGATATCCTTTCACTCTGCAT<br>GGTTGACAGTTCTGCCAGCGCCTGGAAGAGAAAAGGAGATTACAGCTTCCCCAGACT<br>ACCTGGAGATAGCCATTTACTGCATAGGGGTCTTCTTAATCGCCTGTATGGTGGTAA<br>CAGTCATCCTGTGCCGAATGAAGAACACGACCAAGAAGCCAGACTTCAGCAGCCAGC<br>CGGCTGTGCACAAGCTGACCAAACGTATCCCCCTGCGGAGACAGGTTTCGGCTGAGT<br>CCAGCTCCTCCATGAACTCCAACACCCCGCTGGTGAGGATAACAACACGCCTCTCTT<br>CAACGGCAGACACCCCCATGCTGGCAGGGGTCTCCGAGTATGAACTTCCAGAGGACC<br>CAAAATGGGAGTTTCCAAGAGATAAGCTGACACTGGGCAAGCCCCTGGGAGAAGGTT<br>GCTTTGGGCAAGTGGTCATGGCGGAAGCAGTGGGAATTGACAAAGACAAGCCCAAGG<br>AGGCGGTCACCGTGGCCGTGAAGATGTTGAAAGATGATGCCACAGAGAAAGACCTTT<br>CTGATCTGGTGTCAGAGATGGAGATGATGAAGATGATTGGGAAACACAAGAATATCA<br>TAAATCTTCTTGGAGCCTGCACACAGGATGGGCCTCTCTATGTCATAGTTGAGTATG<br>CCTCTAAAGGCAACCTCCGAGAATACCTCCGAGCCCGGAGGCCACCCGGGATGGAGT<br>ACTCCTATGACATTAACCGTGTTCCTGAGGAGCAGATGACCTTCAAGGACTTGGTGT<br>CATGCACCTACCAGCTGGCCAGAGGCATGGAGTACTTGGCTTCCCAAAAATGTATTC<br>ATCGAGATTTAGCAGCCAGAAATGTTTTGGTAACAGAAAACAATGTGATGAAAATAG<br>CAGACTTTGGACTCGCCAGAGATATCAACAATATAGACTATTACAAAAAGACCACCA<br>ATGGGCGGCTTCCAGTCAAGTGGATGGCTCCAGAAGCCCTGTTTGATAGAGTATACA<br>CTCATCAGAGTGATGTCTGGTCCTTCGGGGTGTTAATGTGGGAGATCTTCACTTTAG<br>GGGGCTCGCCCTACCCAGGGATTCCCGTGGAGGAACTTTTTAAGCTGCTGAAGGAAG<br>GACACAGAATGGATAAGCCAGCCAACTGCACCAACGAACTGTACATGATGATGAGGG<br>ACTGTTGGCATGCAGTGCCCTCCCAGAGACCAACGTTCAAGCAGTTGGTAGAAGACT<br>TGGATCGAATTCTCACTCTCACAACCAATGAGGAATACTTGGACCTCAGCCAACCTC<br>TCGAACAGTATTCACCTAGTTACCCTGACACAAGAAGTTCTTGTTCTTCAGGAGATG<br>ATTCTGTTTTTTCTCCAGACCCCATGCCTTACGAACCATGCCTTCCTCAGTATCCAC<br>ACATAAACGGCAGTGTTAAAACATGAATGACTGTGTCTGCCTGTCCCCAAACAGGAC<br>AGCACTGGGAACCTAGCTACACTGAGCAGGGAGACCATGCCTCCCAGAGCTTGTTGT<br>CTCCACTTGTATATATGGATCAGAGGAGTAAATAATTGGAAAAGTAATCAGCATATG<br>TGTAAAGATTTATACAGTTGAAAACTTGTAATCTTCCCCAGGAGGAGAAGAAGGTTT<br>CTGGAGCAGTGGACTGCCACAAGCCACCATGTAACCCCTCTCACCTGCCGTGCGTAC<br>TGGCTGTGGACCAGTAGGACTCAAGGTGGACGTGCGTTCTGCCTTCCTTGTTAATTT<br>TGTAATAATTGGAGAAGATTTATGTCAGCACACACTTACAGAGCACAAATGCAGTAT<br>ATAGGTGCTGGATGTATGTAAATATATTCAAATTATGTATAAATATATATTATATAT<br>TTACAAGGAGTTATTTTTTGTATTGATTTTAAATGGATGTCCCAATGCACCTAGAAA<br>ATTGGTCTCTCTTTTTTTAATAGCTATTTGCTAAATGCTGTTCTTACACATAATTTC<br>TTAATTTTCACCGAGCAGAGGTGGAAAAATACTTTTGCTTTCAGGGAAAATGGTATA<br>ACGTTAATTTATTAATAAATTGGTAATATACAAAACAATTAATCATTTATAGTTTTT<br>TTTGTAATTTAAGTGGCATTTCTATGCAGGCAGCACAGCAGACTAGTTAATCTATTG<br>CTTGGACTTAACTAGTTATCAGATCCTTTGAAAAGAGAATATTTACAATATATGACT<br>AATTTGGGGAAAA |
| SEQ ID NO: 30 | FGFR2 isoform 6 Amino acid sequence | MVSWGRFICLVVVTMATLSLARPSFSLVEDTTLEPEGAPYWTNTEKMEKRLHAVPAA<br>NTVKFRCPAGGNPMPTMRWLKNGKEFKQEHRIGGYKVRNQHWSLIMESVVPSDKGNY<br>TCVVENEYGSINHTYHLDVVERSPHRPILQAGLPANASTVVGGDVEFVCKVYSDAQP<br>HIQWIKHVEKNGSKYGPDGLPYLKVLKAAGVNTTDKEIEVLYIRNVTFEDAGEYTCL<br>AGNSIGISFHSAWLTVLPAPGREKEITASPDYLEIAIYCIGVFLIACMVVTVILCRM<br>KNTTKKPDFSSQPAVHKLTKRIPLRRQVSAESSSSMNSNTPLVRITTRLSSTADTPM<br>LAGVSEYELPEDPKWEFPRDKLTLGKPLGEGCFGQVVMAEAVGIDKDKPKEAVTVAV<br>KMLKDDATEKDLSDLVSEMEMMKMIGKHKNIINLLGACTQDGPLYV**IVEYASKGNLR**<br>EYLRARRPPGMEYSYDINRVPEEQMTFKDLVSCTYQLARGMEYLASQKCIHRDLAAR<br>NVLVTENNVMKIADFGLARDINNIDYYKKTTNGRLPVKWMAPEALFDRVYTHQSDVW<br>SFGVLMWEIFTLGGSPYPGIPVEELFKLLKEGHRMDKPANCTNELYMMMRDCWHAVP<br>SQRPTFKQLVEDLDRILTLTTNEEYLDLSQPLEQYSPSYPDTRSSCSSGDDSVFSPD<br>PMPYEPCLPQYPHINGSVKT |
| SEQ ID NO: 31 | FGFR2 isoform 7 Nucleic acid sequence | CCGGCCGCGAGCCCCGGGGGCCCCGAGGCCGCAGCTTGCCTGCGCGCTCTGAGCCTT<br>CGCAACTCGCGAGCAAAGTTTGGTGGAGGCAACGCCAAGCCTGAGTCCTTTCTTCCT<br>CTCGTTCCCCAAATCCGAGGGCAGCCCGCGGGCGTCATGCCCGCGCTCCTCCGCAGC<br>CTGGGGTACGCGTGAAGCCCGGGAGGCTTGGCGCCGGCGAAGACCCAAGGACCACTC<br>TTCTGCGTTTGGAGTTGCTCCCCGCAACCCCGGGCTCGTCGCTTTCTCCATCCCGAC<br>CCACGCGGGGCGCGGGGACAACACAGGTCGCGGAGGAGCGTTGCCATTCAAGTGACT<br>GCAGCAGCAGCGGCAGCGCCTCGGTTCCTGAGCCCACCGCAGGCTGAAGGCATTGCG |

TABLE 3-continued

| FGFR sequences | | |
|---|---|---|
| | | CGTAGTCCATGCCCGTAGAGGAAGTGTGCAGATGGGATTAACGTCCACATGGAGATA<br>TGGAAGAGGACCGGGGATTGGTACCGTAACCATGGTCAGCTGGGGTCGTTTCATCTG<br>CCTGGTCGTGGTCACCATGGCAACCTTGTCCCTGGCCCGGCCCTCCTTCAGTTTAGT<br>TGAGGATACCACATTAGAGCCAGAAGAGCCACCAACCAAATACCAAATCTCTCAACC<br>AGAAGTGTACGTGGCTGCGCCAGGGGAGTCGCTAGAGGTGCGCTGCCTGTTGAAAGA<br>TGCCGCCGTGATCAGTTGGACTAAGGATGGGGTGCACTTGGGGCCCAACAATAGGAC<br>AGTGCTTATTGGGGAGTACTTGCAGATAAAGGGCGCCACGCCTAGAGACTCCGGCCT<br>CTATGCTTGTACTGCCAGTAGGACTGTAGACAGTGAAACTTGGTACTTCATGGTGAA<br>TGTCACAGATGCCATCTCATCCGGAGATGATGAGGATGACACCGATGGTGCGGAAGA<br>TTTTGTCAGTGAGAACAGTAACAACAAGAGAGCACCATACTGGACCAACACAGAAAA<br>GATGGAAAAGCGGCTCCATGCTGTGCCTGCGGCCAACACTGTCAAGTTTCGCTGCCC<br>AGCCGGGGGGAACCCAATGCCAACCATGCGGTGGCTGAAAAACGGGAAGGAGTTTAA<br>GCAGGAGCATCGCATTGGAGGCTACAAGGTACGAAACCAGCACTGGAGCCTCATTAT<br>GGAAAGTGTGGTCCCATCTGACAAGGGAAATTATACCTGTGTAGTGGAGAATGAATA<br>CGGGTCCATCAATCACACGTACCACCTGGATGTTGTGGAGCGATCGCCTCACCGGCC<br>CATCCTCCAAGCCGGACTGCCGGCAAATGCCTCCACAGTGGTCGGAGGAGACGTAGA<br>GTTTGTCTGCAAGGTTTACAGTGATGCCCAGCCCCACATCCAGTGGATCAAGCACGT<br>GGAAAAGAACGGCAGTAAATACGGGCCCGACGGGCTGCCCTACCTCAAGGTTCTCAA<br>GGTTTCGGCTGAGTCCAGCTCCTCCATGAACTCCAACACCCCGCTGGTGAGGATAAC<br>AACACGCCTCTCTTCAACGGCAGACACCCCCATGCTGGCAGGGGTCTCCGAGTATGA<br>ACTTCCAGAGGACCCAAAATGGGAGTTTCCAAGAGATAAGCTGACACTGGGCAAGCC<br>CCTGGGAGAAGGTTGCTTTGGGCAAGTGGTCATGGCGGAAGCAGTGGGAATTGACAA<br>AGACAAGCCCAAGGAGGCGGTCACCGTGGCCGTGAAGATGTTGAAAGATGATGCCAC<br>AGAGAAAGACCTTTCTGATCTGGTGTCAGAGATGGAGATGATGAAGATGATTGGGAA<br>ACACAAGAATATCATAAATCTTCTTGGAGCCTGCACACAGGATGGGCCTCTCTATGT<br>CATAGTTGAGTATGCCTCTAAAGGCAACCTCCGAGAATACCTCCGAGCCCGGAGGCC<br>ACCCGGGATGGAGTACTCCTATGACATTAACCGTGTTCCTGAGGAGCAGATGACCTT<br>CAAGGACTTGGTGTCATGCACCTACCAGCTGGCCAGAGGCATGGAGTACTTGGCTTC<br>CCAAAAATGTATTCATCGAGATTTAGCAGCCAGAAATGTTTTGGTAACAGAAAACAA<br>TGTGATGAAAATAGCAGACTTTGGACTCGCCAGAGATATCAACAATATAGACTATTA<br>CAAAAAGACCACCAATGGGCGGCTTCCAGTCAAGTGGATGGCTCCAGAAGCCCTGTT<br>TGATAGAGTATACACTCATCAGAGTGATGTCTGGTCCTTCGGGGTGTTAATGTGGGA<br>GATCTTCACTTTAGGGGGCTCGCCCTACCCAGGGATTCCCGTGGAGGAACTTTTTAA<br>GCTGCTGAAGGAAGGACACAGAATGGATAAGCCAGCCAACTGCACCAACGAACTGTA<br>CATGATGATGAGGGACTGTTGGCATGCAGTGCCCTCCCAGAGACCAACGTTCAAGCA<br>GTTGGTAGAAGACTTGGATCGAATTCTCACTCTCACAACCAATGAGGAATACTTGGA<br>CCTCAGCCAACCTCTCGAACAGTATTCACCTAGTTACCCTGACACAAGAAGTTCTTG<br>TTCTTCAGGAGATGATTCTGTTTTTTCTCCAGACCCCATGCCTTACGAACCATGCCT<br>TCCTCAGTATCCACACATAAACGGCAGTGTTAAAACATGAATGACTGTGTCTGCCTG<br>TCCCCAAACAGGACAGCACTGGGAACCTAGCTACACTGAGCAGGGAGACCATGCCTC<br>CCAGAGCTTGTTGTCTCCACTTGTATATATGGATCAGAGGAGTAAATAATTGGAAAA<br>GTAATCAGCATATGTGTAAAGATTTATACAGTTGAAAACTTGTAATCTTCCCCAGGA<br>GGAGAAGAAGGTTTCTGGAGCAGTGGACTGCCACAAGCCACCATGTAACCCCTCTCA<br>CCTGCCGTGCGTACTGGCTGTGGACCAGTAGGACTCAAGGTGGACGTGCGTTCTGCC<br>TTCCTTGTTAATTTTGTAATAATTGGAGAAGATTTATGTCAGCACACACTTACAGAG<br>CACAAATGCAGTATATAGGTGCTGGATGTATGTAAATATATTCAAATTATGTATAAA<br>TATATATTATATATTTACAAGGAGTTATTTTTTGTATTGATTTTAAATGGATGTCCC<br>AATGCACCTAGAAAATTGGTCTCTCTTTTTTTAATAGCTATTTGCTAAATGCTGTTC<br>TTACACATAATTTCTTAATTTTCACCGAGCAGAGGTGGAAAAATACTTTTGCTTTCA<br>GGGAAAATGGTATAACGTTAATTTATTAATAAATTGGTAATATACAAAACAA |
| SEQ ID NO: 32 | FGFR2 isoform 7 Amino acid sequence | MVSWGRFICLVVVTMATLSLARPSFSLVEDTTLEPEEPPTKYQISQPEVYVAAPGES<br>LEVRCLLKDAAVISWTKDGVHLGPNNRTVLIGEYLQIKGATPRDSGLYACTASRTVD<br>SETWYFMVNVTDAISSGDDEDDTDGAEDFVSENSNNKRAPYWTNTEKMEKRLHAVPA<br>ANTVKFRCPAGGNPMPTMRWLKNGKEFKQEHRIGGYKVRNQHWSLIMESVVPSDKGN<br>YTCVVENEYGSINHTYHLDVVERSPHRPILQAGLPANASTVVGGDVEFVCKVYSDAQ<br>PHIQWIKHVEKNGSKYGPDGLPYLKVLKVSAESSSSMNSNTPLVRITTRLSSTADTP<br>MLAGVSEYELPEDPKWEFPRDKLTLGKPLGEGCFGQVVMAEAVGIDKDKPKEAVTVA<br>VKMLKDDATEKDLSDLVSEMEMMKMIGKHKNIINLLGACTQDGPLYV**IVEYASKGNL**<br>**R**EYLRARRPPGMEYSYDINRVPEEQMTFKDLVSCTYQLARGMEYLASQKCIHRDLAA<br>RNVLVTENNVMKIADFGLARDINNIDYYKKTTNGRLPVKWMAPEALFDRVYTHQSDV<br>WSFGVLMWEIFTLGGSPYPGIPVEELFKLLKEGHRMDKPANCTNELYMMMRDCWHAV<br>PSQRPTFKQLVEDLDRILTLTTNEEYLDLSQPLEQYSPSYPDTRSSCSSGDDSVFSP<br>DPMPYEPCLPQYPHINGSVKT |
| SEQ ID NO: 33 | FGFR2 isoform 8 Nucleic acid sequence | GAGCGGGCGAGGGAGCGCGCGCGGCCGCCACAAAGCTCGGGCGCCGCGGGGCTGCAT<br>GCGGCGTACCTGGCCCGGCGCGGCGACTGCTCTCCGGGCTGGCGGGGGCCGGCCGCG<br>AGCCCCGGGGGCCCCGAGGCCGCAGCTTGCCTGCGCGCTCTGAGCCTTCGCAACTCG<br>CGAGCAAAGTTTGGTGGAGGCAACGCCAAGCCTGAGTCCTTTCTTCCTCTCGTTCCC<br>CAAATCCGAGGGCAGCCCGCGGGCGTCATGCCCGCGCTCCTCCGCAGCCTGGGGTAC<br>GCGTGAAGCCCGGGAGGCTTGGCGCCGGCGAAGACCCAAGGACCACTCTTCTGCGTT<br>TGGAGTTGCTCCCCGCAACCCCGGGCTCGTCGCTTTCTCCATCCCGACCCACGCGGG<br>GCGCGGGGACAACACAGGTCGCGGAGGAGCGTTGCCATTCAAGTGACTGCAGCAGCA<br>GCGGCAGCGCCTCGGTTCCTGAGCCCACCGCAGGCTGAAGGCATTGCGCGTAGTCCA<br>TGCCCGTAGAGGAAGTGTGCAGATGGGATTAACGTCCACATGGAGATATGGAAGAGG<br>ACCGGGGATTGGTACCGTAACCATGGTCAGCTGGGGTCGTTTCATCTGCCTGGTCGT<br>GGTCACCATGGCAACCTTGTCCCTGGCCCGGCCCTCCTTCAGTTTAGTTGAGGATAC<br>CACATTAGAGCCAGAAGAGCCACCAACCAAATACCAAATCTCTCAACCAGAAGTGTA |

TABLE 3-continued

| FGFR sequences | | |
|---|---|---|
| | | CGTGGCTGCGCCAGGGGAGTCGCTAGAGGTGCGCTGCCTGTTGAAAGATGCCGCCGT<br>GATCAGTTGGACTAAGGATGGGGTGCACTTGGGGCCCAACAATAGGACAGTGCTTAT<br>TGGGGAGTACTTGCAGATAAAGGGCGCCACGCCTAGAGACTCCGGCCTCTATGCTTG<br>TACTGCCAGTAGGACTGTAGACAGTGAAACTTGGTACTTCATGGTGAATGTCACAGA<br>TGCCATCTCATCCGGAGATGATGAGGATGACACCGATGGTGCGGAAGATTTTGTCAG<br>TGAGAACAGTAACAACAAGAGAGCACCATACTGGACCAACACAGAAAAGATGGAAAA<br>GCGGCTCCATGCTGTGCCTGCGGCCAACACTGTCAAGTTTCGCTGCCCAGCCGGGGG<br>GAACCCAATGCCAACCATGCGGTGGCTGAAAAACGGGAAGGAGTTTAAGCAGGAGCA<br>TCGCATTGGAGGCTACAAGGTACGAAACCAGCACTGGAGCCTCATTATGGAAAGTGT<br>GGTCCCATCTGACAAGGGAAATTATACCTGTGTAGTGGAGAATGAATACGGGTCCAT<br>CAATCACACGTACCACCTGGATGTTGTGGAGCGATCGCCTCACCGGCCCATCCTCCA<br>AGCCGGACTGCCGGCAAATGCCTCCACAGTGGTCGGAGGAGACGTAGAGTTTGTCTG<br>CAAGGTTTACAGTGATGCCCAGCCCCACATCCAGTGGATCAAGCACGTGGAAAAGAA<br>CGGCAGTAAATACGGGCCCGACGGGCTGCCCTACCTCAAGGTTCTCAAGCACTCGGG<br>GATAAATAGTTCCAATGCAGAAGTGCTGGCTCTGTTCAATGTGACCGAGGCGGATGC<br>TGGGGAATATATATGTAAGGTCTCCAATTATATAGGGCAGGCCAACCAGTCTGCCTG<br>GCTCACTGTCCTGCCAAAACAGCAAGCGCCTGGAAGAGAAAAGGAGATTACAGCTTC<br>CCCAGACTACCTGGAGATAGCCATTTACTGCATAGGGGTCTTCTTAATCGCCTGTAT<br>GGTGGTAACAGTCATCCTGTGCCGAATGAAGAACACGACCAAGAAGCCAGACTTCAG<br>CAGCCAGCCGGCTGTGCACAAGCTGACCAAACGTATCCCCCTGCGGAGACAGGTAAC<br>AGTTTCGGCTGAGTCCAGCTCCTCCATGAACTCCAACACCCCGCTGGTGAGGATAAC<br>AACACGCCTCTCTTCAACGGCAGACACCCCCATGCTGGCAGGGGTCTCCGAGTATGA<br>ACTTCCAGAGGACCCAAAATGGGAGTTTCCAAGAGATAAGCTGACACTGGGCAAGCC<br>CCTGGGAGAAGGTTGCTTTGGGCAAGTGGTCATGGCGGAAGCAGTGGGAATTGACAA<br>AGACAAGCCCAAGGAGGCGGTCACCGTGGCCGTGAAGATGTTGAAAGATGATGCCAC<br>AGAGAAAGACCTTTCTGATCTGGTGTCAGAGATGGAGATGATGAAGATGATTGGGAA<br>ACACAAGAATATCATAAATCTTCTTGGAGCCTGCACACAGGATGGGCCTCTCTATGT<br>CATAGTTGAGTATGCCTCTAAAGGCAACCTCCGAGAATACCTCCGAGCCCGGAGGCC<br>ACCCGGGATGGAGTACTCCTATGACATTAACCGTGTTCCTGAGGAGCAGATGACCTT<br>CAAGGACTTGGTGTCATGCACCTACCAGCTGGCCAGAGGCATGGAGTACTTGGCTTC<br>CCAAAAATGTATTCATCGAGATTTAGCAGCCAGAAATGTTTTGGTAACAGAAAACAA<br>TGTGATGAAAATAGCAGACTTTGGACTCGCCAGAGATATCAACAATATAGACTATTA<br>CAAAAAGACCACCAATGGGCGGCTTCCAGTCAAGTGGATGGCTCCAGAAGCCCTGTT<br>TGATAGAGTATACACTCATCAGAGTGATGTCTGGTCCTTCGGGGTGTTAATGTGGGA<br>GATCTTCACTTTAGGGGGCTCGCCCTACCCAGGGATTCCCGTGGAGGAACTTTTTAA<br>GCTGCTGAAGGAAGGACACAGAATGGATAAGCCAGCCAACTGCACCAACGAACTGTA<br>CATGATGATGAGGGACTGTTGGCATGCAGTGCCCTCCCAGAGACCAACGTTCAAGCA<br>GTTGGTAGAAGACTTGGATCGAATTCTCACTCTCACAACCAATGAGGAATACTTGGA<br>CCTCAGCCAACCTCTCGAACAGTATTCACCTAGTTACCCTGACACAAGAAGTTCTTG<br>TTCTTCAGGAGATGATTCTGTTTTTTCTCCAGACCCCATGCCTTACGAACCATGCCT<br>TCCTCAGTATCCACACATAAACGGCAGTGTTAAAACATGA |
| SEQ ID NO: 34 | FGFR2 isoform 8 Amino acid sequence | MVSWGRFICLVVVTMATLSLARPSFSLVEDTTLEPEEPPTKYQISQPEVYVAAPGES<br>LEVRCLLKDAAVISWTKDGVHLGPNNRTVLIGEYLQIKGATPRDSGLYACTASRTVD<br>SETWYFMVNVTDAISSGDDEDDTDGAEDFVSENSNNKRAPYWTNTEKMEKRLHAVPA<br>ANTVKFRCPAGGNPMPTMRWLKNGKEFKQEHRIGGYKVRNQHWSLIMESVVPSDKGN<br>YTCVVENEYGSINHTYHLDVVERSPHRPILQAGLPANASTVVGGDVEFVCKVYSDAQ<br>PHIQWIKHVEKNGSKYGPDGLPYLKVLKHSGINSSNAEVLALFNVTEADAGEYICKV<br>SNYIGQANQSAWLTVLPKQQAPGREKEITASPDYLEIAIYCIGVFLIACMVVTVILC<br>RMKNTTKKPDFSSQPAVHKLTKRIPLRRQVTVSAESSSSMNSNTPLVRITTRLSSTA<br>DTPMLAGVSEYELPEDPKWEFPRDKLTLGKPLGEGCFGQVVMAEAVGIDKDKPKEAV<br>TVAVKMLKDDATEKDLSDLVSEMEMMKMIGKHKNIINLLGACTQDGPLYV**IVEYASK**<br>**GNLR**EYLRARRPPGMEYSYDINRVPEEQMTFKDLVSCTYQLARGMEYLASQKCIHRD<br>LAARNVLVTENNVMKIADFGLARDINNIDYYKKTTNGRLPVKWMAPEALFDRVYTHQ<br>SDVWSFGVLMWEIFTLGGSPYPGIPVEELFKLLKEGHRMDKPANCTNELYMMMRDCW<br>HAVPSQRPTFKQLVEDLDRILTLTTNEEYLDLSQPLEQYSPSYPDTRSSCSSGDDSV<br>FSPDPMPYEPCLPQYPHINGSVKT |
| SEQ ID NO: 35 | FGFR2 isoform 9 Nucleic acid sequence | GAGAGCCGAGCGGGCGGGCGGCGGGTGCGGAGCGGGCGAGGGAGCGCGCGCGGCCGC<br>CACAAAGCTCGGGCGCCGCGGGGCTGCATGCGGCGTACCTGGCCCGGCGCGGCGACT<br>GCTCTCCGGGCTGGCGGGGGCCGGCCGCGAGCCCCGGGGGCCCCGAGGCCGCAGCTT<br>GCCTGCGCGCTCTGAGCCTTCGCAACTCGCGAGCAAAGTTTGGTGGAGGCAACGCCA<br>AGCCTGAGTCCTTTCTTCCTCTCGTTCCCCAAATCCGAGGGCAGCCCGCGGGCGTCA<br>TGCCCGCGCTCCTCCGCAGCCTGGGGTACGCGTGAAGCCCGGGAGGCTTGGCGCCGG<br>CGAAGACCCAAGGACCACTCTTCTGCGTTTGGAGTTGCTCCCCGCAACCCCGGGCTC<br>GTCGCTTTCTCCATCCCGACCCACGCGGGGCGCGGGGACAACACAGGTCGCGGAGGA<br>GCGTTGCCATTCAAGTGACTGCAGCAGCAGCGGCAGCGCCTCGGTTCCTGAGCCCAC<br>CGCAGGCTGAAGGCATTGCGCGTAGTCCATGCCCGTAGAGGAAGTGTGCAGATGGGA<br>TTAACGTCCACATGGAGATATGGAAGAGGACCGGGGATTGGTACCGTAACCATGGTC<br>AGCTGGGGTCGTTTCATCTGCCTGGTCGTGGTCACCATGGCAACCTTGTCCCTGGCC<br>CGGCCCTCCTTCAGTTTAGTTGAGGATACCACATTAGAGCCAGAAGATGCCATCTCA<br>TCCGGAGATGATGAGGATGACACCGATGGTGCGGAAGATTTTGTCAGTGAGAACAGT<br>AACAACAAGAGAGCACCATACTGGACCAACACAGAAAAGATGGAAAAGCGGCTCCAT<br>GCTGTGCCTGCGGCCAACACTGTCAAGTTTCGCTGCCCAGCCGGGGGGAACCCAATG<br>CCAACCATGCGGTGGCTGAAAAACGGGAAGGAGTTTAAGCAGGAGCATCGCATTGGA<br>GGCTACAAGGTACGAAACCAGCACTGGAGCCTCATTATGGAAAGTGTGGTCCCATCT<br>GACAAGGGAAATTATACCTGTGTAGTGGAGAATGAATACGGGTCCATCAATCACACG<br>TACCACCTGGATGTTGTGGAGCGATCGCCTCACCGGCCCATCCTCCAAGCCGGACTG |

TABLE 3-continued

| FGFR sequences | | |
|---|---|---|
| | | CCGGCAAATGCCTCCACAGTGGTCGGAGGAGACGTAGAGTTTGTCTGCAAGGTTTAC<br>AGTGATGCCCAGCCCCACATCCAGTGGATCAAGCACGTGGAAAAGAACGGCAGTAAA<br>TACGGGCCCGACGGGCTGCCCTACCTCAAGGTTCTCAAGCACTCGGGGATAAATAGT<br>TCCAATGCAGAAGTGCTGGCTCTGTTCAATGTGACCGAGGCGGATGCTGGGGAATAT<br>ATATGTAAGGTCTCCAATTATATAGGGCAGGCCAACCAGTCTGCCTGGCTCACTGTC<br>CTGCCAAAACAGCAAGCGCCTGGAAGAGAAAAGGAGATTACAGCTTCCCCAGACTAC<br>CTGGAGATAGCCATTTACTGCATAGGGGTCTTCTTAATCGCCTGTATGGTGGTAACA<br>GTCATCCTGTGCCGAATGAAGAACACGACCAAGAAGCCAGACTTCAGCAGCCAGCCG<br>GCTGTGCACAAGCTGACCAAACGTATCCCCCTGCGGAGACAGGTAACAGTTTCGGCT<br>GAGTCCAGCTCCTCCATGAACTCCAACACCCCGCTGGTGAGGATAACAACACGCCTC<br>TCTTCAACGGCAGACACCCCCATGCTGGCAGGGGTCTCCGAGTATGAACTTCCAGAG<br>GACCCAAAATGGGAGTTTCCAAGAGATAAGCTGACACTGGGCAAGCCCCTGGGAGAA<br>GGTTGCTTTGGGCAAGTGGTCATGGCGGAAGCAGTGGGAATTGACAAAGACAAGCCC<br>AAGGAGGCGGTCACCGTGGCCGTGAAGATGTTGAAAGATGATGCCACAGAGAAAGAC<br>CTTTCTGATCTGGTGTCAGAGATGGAGATGATGAAGATGATTGGGAAACACAAGAAT<br>ATCATAAATCTTCTTGGAGCCTGCACACAGGATGGGCCTCTCTATGTCATAGTTGAG<br>TATGCCTCTAAAGGCAACCTCCGAGAATACCTCCGAGCCCGGAGGCCACCCGGGATG<br>GAGTACTCCTATGACATTAACCGTGTTCCTGAGGAGCAGATGACCTTCAAGGACTTG<br>GTGTCATGCACCTACCAGCTGGCCAGAGGCATGGAGTACTTGGCTTCCCAAAAATGT<br>ATTCATCGAGATTTAGCAGCCAGAAATGTTTTGGTAACAGAAAACAATGTGATGAAA<br>ATAGCAGACTTTGGACTCGCCAGAGATATCAACAATATAGACTATTACAAAAAGACC<br>ACCAATGGGCGGCTTCCAGTCAAGTGGATGGCTCCAGAAGCCCTGTTTGATAGAGTA<br>TACACTCATCAGAGTGATGTCTGGTCCTTCGGGGTGTTAATGTGGGAGATCTTCACT<br>TTAGGGGGCTCGCCCTACCCAGGGATTCCCGTGGAGGAACTTTTTAAGCTGCTGAAG<br>GAAGGACACAGAATGGATAAGCCAGCCAACTGCACCAACGAACTGTACATGATGATG<br>AGGGACTGTTGGCATGCAGTGCCCTCCCAGAGACCAACGTTCAAGCAGTTGGTAGAA<br>GACTTGGATCGAATTCTCACTCTCACAACCAATGAGATCTGAAAGTTTATGGCTTCA<br>TTGAGAAACTGGGAAAAGTTGGTCAGGCGCAGTGGCTCATGCCTGTAATCCCAGCAC<br>TTTGGGAGGCCGAGGCAGGCGGATCATGAGGTCAGGAGTTCCAGACCAGCCTGGCCA<br>ACATGGTGAAACCCTGTCTCTACTAAAGATACAAAAAATTAGCCGGGCGTGTTGGTG<br>TGCACCTGTAATCCCAGCTACTCCGGGAGGCTGAGGCAGGAGAGTCACTTGAACCGG<br>GGAGGCGGAGGTTGCAGTGAGCCGAGATCATGCCATTGCATTCCAGCCTTGGCGACA<br>GAGCGAGACTCCGTCTCAAAAAAAAATAAAAA |
| SEQ ID NO: 36 | FGFR2 isoform 9 Amino acid sequence | MVSWGRFICLVVVTMATLSLARPSFSLVEDTTLEPEDAISSGDDEDDTDGAEDFVSE<br>NSNNKRAPYWTNTEKMEKRLHAVPAANTVKFRCPAGGNPMPTMRWLKNGKEFKQEHR<br>IGGYKVRNQHWSLIMESVVPSDKGNYTCVVENEYGSINHTYHLDVVERSPHRPILQA<br>GLPANASTVVGGDVEFVCKVYSDAQPHIQWIKHVEKNGSKYGPDGLPYLKVLKHSGI<br>NSSNAEVLALFNVTEADAGEYICKVSNYIGQANQSAWLTVLPKQQAPGREKEITASP<br>DYLEIAIYCIGVFLIACMVVTVILCRMKNTTKKPDFSSQPAVHKLTKRIPLRRQVTV<br>SAESSSSMNSNTPLVRITTRLSSTADTPMLAGVSEYELPEDPKWEFPRDKLTLGKPL<br>GEGCFGQVVMAEAVGIDKDKPKEAVTVAVKMLKDDATEKDLSDLVSEMEMMKMIGKH<br>KNIINLLGACTQDGPLYV**IVEYASKGNLR**EYLRARRPPGMEYSYDINRVPEEQMTFK<br>DLVSCTYQLARGMEYLASQKCIHRDLAARNVLVTENNVMKIADFGLARDINNIDYYK<br>KTTNGRLPVKWMAPEALFDRVYTHQSDVWSFGVLMWEIFTLGGSPYPGIPVEELFKL<br>LKEGHRMDKPANCTNELYMMMRDCWHAVPSQRPTFKQLVEDLDRILTLTTNEI |
| SEQ ID NO: 37 | FGFR2 isoform 10 Nucleic acid sequence | GGACCGGGGATTGGTACCGTAACCATGGTCAGCTGGGGTCGTTTCATCTGCCTGGTC<br>GTGGTCACCATGGCAACCTTGTCCCTGGCCCGGCCCTCCTTCAGTTTAGTTGAGGAT<br>ACCACATTAGAGCCAGAAGAGCCACCAACCAAATACCAAATCTCTCAACCAGAAGTG<br>TACGTGGCTGCGCCAGGGGAGTCGCTAGAGGTGCGCTGCCTGTTGAAAGATGCCGCC<br>GTGATCAGTTGGACTAAGGATGGGGTGCACTTGGGGCCCAACAATAGGACAGTGCTT<br>ATTGGGGAGTACTTGCAGATAAAGGGCGCCACGCCTAGAGACTCCGGCCTCTATGCT<br>TGTACTGCCAGTAGGACTGTAGACAGTGAAACTTGGTACTTCATGGTGAATGTCACA<br>GATGCCATCTCATCCGGAGATGATGAGGATGACACCGATGGTGCGGAAGATTTTGTC<br>AGTGAGAACAGTAACAACAAGAGAGCACCATACTGGACCAACACAGAAAAGATGGAA<br>AAGCGGCTCCATGCTGTGCCTGCGGCCAACACTGTCAAGTTTCGCTGCCCAGCCGGG<br>GGGAACCCAATGCCAACCATGCGGTGGCTGAAAAACGGGAAGGAGTTTAAGCAGGAG<br>CATCGCATTGGAGGCTACAAGGTACGAAACCAGCACTGGAGCCTCATTATGGAAAGT<br>GTGGTCCCATCTGACAAGGGAAATTATACCTGTGTAGTGGAGAATGAATACGGGTCC<br>ATCAATCACACGTACCACCTGGATGTTGTGGAGCGATCGCCTCACCGGCCCATCCTC<br>CAAGCCGGACTGCCGGCAAATGCCTCCACAGTGGTCGGAGGAGACGTAGAGTTTGTC<br>TGCAAGGTTTACAGTGATGCCCAGCCCCACATCCAGTGGATCAAGCACGTGGAAAAG<br>AACGGCAGTAAATACGGGCCCGACGGGCTGCCCTACCTCAAGGTTCTCAAGCACTCG<br>GGGATAAATAGTTCCAATGCAGAAGTGCTGGCTCTGTTCAATGTGACCGAGGCGGAT<br>GCTGGGGAATATATATGTAAGGTCTCCAATTATATAGGGCAGGCCAACCAGTCTGCC<br>TGGCTCACTGTCCTGCCAAAACAGCAAGCGCCTGGAAGAGAAAAGGAGATTACAGCT<br>TCCCCAGACTACCTGGAGATAGCCATTTACTGCATAGGGGTCTTCTTAATCGCCTGT<br>ATGGTGGTAACAGTCATCCTGTGCCGAATGAAGAACACGACCAAGAAGCCAGACTTC<br>AGCAGCCAGCCGGCTGTGCACAAGCTGACCAAACGTATCCCCCTGCGGAGACAGGTA<br>ACAGTTTCGGCTGAGTCCAGCTCCTCCATGAACTCCAACACCCCGCTGGTGAGGATA<br>ACAACACGCCTCTCTTCAACGGCAGACACCCCCATGCTGGCAGGGGTCTCCGAGTAT<br>GAACTTCCAGAGGACCCAAAATGGGAGTTTCCAAGAGATAAGCTGACACTGGGCAAG<br>CCCCTGGGAGAAGGTTGCTTTGGGCAAGTGGTCATGGCGGAAGCAGTGGGAATTGAC<br>AAAGACAAGCCCAAGGAGGCGGTCACCGTGGCCGTGAAGATGTTGAAAGATGATGCC<br>ACAGAGAAAGACCTTTCTGATCTGGTGTCAGAGATGGAGATGATGAAGATGATTGGG<br>AAACACAAGAATATCATAAATCTTCTTGGAGCCTGCACACAGGATGGGCCTCTCTAT<br>GTCATAGTTGAGTATGCCTCTAAAGGCAACCTCCGAGAATACCTCCGAGCCCGGAGG |

TABLE 3-continued

| FGFR sequences | | |
|---|---|---|
| | | CCACCCGGGATGGAGTACTCCTATGACATTAACCGTGTTCCTGAGGAGCAGATGACC<br>TTCAAGGACTTGGTGTCATGCACCTACCAGCTGGCCAGAGGCATGGAGTACTTGGCT<br>TCCCAAAAATGTATTCATCGAGATTTAGCAGCCAGAAATGTTTTGGTAACAGAAAAC<br>AATGTGATGAAAATAGCAGACTTTGGACTCGCCAGAGATATCAACAATATAGACTAT<br>TACAAAAAGACCACCAATGGGCGGCTTCCAGTCAAGTGGATGGCTCCAGAAGCCCTG<br>TTTGATAGAGTATACACTCATCAGAGTGATGTCTGGTCCTTCGGGGTGTTAATGTGG<br>GAGATCTTCACTTTAGGGGGCTCGCCCTACCCAGGGATTCCCGTGGAGGAACTTTTT<br>AAGCTGCTGAAGGAAGGACACAGAATGGATAAGCCAGCCAACTGCACCAACGAACTG<br>TACATGATGATGAGGGACTGTTGGCATGCAGTGCCCTCCCAGAGACCAACGTTCAAG<br>CAGTTGGTAGAAGACTTGGATCGAATTCTCACTCTCACAACCAATGAGATCTGAAAG<br>TTTATGGCTTCATTGAGAAACTGGGAAAAGTTGGTCAGGCGCAGTGGCTCATGCCTG<br>TAATCCCAGCACTTTGGGAGGCCGAGGCAGGCGGATCATGAGGTCAGGAGTTCCAGA<br>CCAGCCTGGCCAACATGGTGAAACCCTGTCTCTACTAAAGATACAAAAAATTAGCCG<br>GGCGTGTTGGTGTGCACCTGTAATCCCAGCTACTCCGGGAGGCTGAGGCAGGAGAGT<br>CACTTGAACCGGGGAGGCGGAGGTTGCAGTGAGCCGAGATCATGCCATTGCATTCCA<br>GCCTTGGCGACAGAGCGAGACTCCGTCT |
| SEQ ID NO: 38 | FGFR2 isoform 10 Amino acid sequence | MVSWGRFICLVVVTMATLSLARPSFSLVEDTTLEPEEPPTKYQISQPEVYVAAPGES<br>LEVRCLLKDAAVISWTKDGVHLGPNNRTVLIGEYLQIKGATPRDSGLYACTASRTVD<br>SETWYFMVNVTDAISSGDDEDDTDGAEDFVSENSNNKRAPYWTNTEKMEKRLHAVPA<br>ANTVKFRCPAGGNPMPTMRWLKNGKEFKQEHRIGGYKVRNQHWSLIMESVVPSDKGN<br>YTCVVENEYGSINHTYHLDVVERSPHRPILQAGLPANASTVVGGDVEFVCKVYSDAQ<br>PHIQWIKHVEKNGSKYGPDGLPYLKVLKHSGINSSNAEVLALFNVTEADAGEYICKV<br>SNYIGQANQSAWLTVLPKQQAPGREKEITASPDYLEIAIYCIGVFLIACMVVTVILC<br>RMKNTTKKPDFSSQPAVHKLTKRIPLRRQVTVSAESSSSMNSNTPLVRITTRLSSTA<br>DTPMLAGVSEYELPEDPKWEFPRDKLTLGKPLGEGCFGQVVMAEAVGIDKDKPKEAV<br>TVAVKMLKDDATEKDLSDLVSEMEMMKMIGKHKNIINLLGACTQDGPLYV**IVEYASK**<br>**GNLR**EYLRARRPPGMEYSYDINRVPEEQMTFKDLVSCTYQLARGMEYLASQKCIHRD<br>LAARNVLVTENNVMKIADFGLARDINNIDYYKKTTNGRLPVKWMAPEALFDRVYTHQ<br>SDVWSFGVLMWEIFTLGGSPYPGIPVEELFKLLKEGHRMDKPANCTNELYMMMRDCW<br>HAVPSQRPTFKQLVEDLDRILTLTTNEI |
| SEQ ID NO: 39 | FGFR2 isoform 11 Nucleic acid sequence | GGTACCGTAACCATGGTCAGCTGGGGTCGTTTCATCTGCCTGGTCGTGGTCACCATG<br>GCAACCTTGTCCCTGGCCCGGCCCTCCTTCAGTTTAGTTGAGGATACCACATTAGAG<br>CCAGAAGAGCCACCAACCAAATACCAAATCTCTCAACCAGAAGTGTACGTGGCTGCG<br>CCAGGGGAGTCGCTAGAGGTGCGCTGCCTGTTGAAAGATGCCGCCGTGATCAGTTGG<br>ACTAAGGATGGGGTGCACTTGGGGCCCAACAATAGGACAGTGCTTATTGGGGAGTAC<br>TTGCAGATAAAGGGCGCCACGCCTAGAGACTCCGGCCTCTATGCTTGTACTGCCAGT<br>AGGACTGTAGACAGTGAAACTTGGTACTTCATGGTGAATGTCACAGATGCCATCTCA<br>TCCGGAGATGATGAGGATGACACCGATGGTGCGGAAGATTTTGTCAGTGAGAACAGT<br>AACAACAAGAGAGCACCATACTGGACCAACACAGAAAAGATGGAAAAGCGGCTCCAT<br>GCTGTGCCTGCGGCCAACACTGTCAAGTTTCGCTGCCCAGCCGGGGGGAACCCAATG<br>CCAACCATGCGGTGGCTGAAAAACGGGAAGGAGTTTAAGCAGGAGCATCGCATTGGA<br>GGCTACAAGGTACGAAACCAGCACTGGAGCCTCATTATGGAAAGTGTGGTCCCATCT<br>GACAAGGGAAATTATACCTGTGTAGTGGAGAATGAATACGGGTCCATCAATCACACG<br>TACCACCTGGATGTTGTGGAGCGATCGCCTCACCGGCCCATCCTCCAAGCCGGACTG<br>CCGGCAAATGCCTCCACAGTGGTCGGAGGAGACGTAGAGTTTGTCTGCAAGGTTTAC<br>AGTGATGCCCAGCCCCACATCCAGTGGATCAAGCACGTGGAAAAGAACGGCAGTAAA<br>TACGGGCCCGACGGGCTGCCCTACCTCAAGGTTCTCAAGGCCGCCGGTGTTAACACC<br>ACGGACAAAGAGATTGAGGTTCTCTATATTCGGAATGTAACTTTTGAGGACGCTGGG<br>GAATATACGTGCTTGGCGGGTAATTCTATTGGGATATCCTTTCACTCTGCATGGTTG<br>ACAGTTCTGCCAGCGCCTGGAAGAGAAAAGGAGATTACAGCTTCCCCAGACTACCTG<br>GAGATAGCCATTTACTGCATAGGGGTCTTCTTAATCGCCTGTATGGTGGTAACAGTC<br>ATCCTGTGCCGAATGAAGAACACGACCAAGAAGCCAGACTTCAGCAGCCAGCCGGCT<br>GTGCACAAGCTGACCAAACGTATCCCCCTGCGGAGACAGGTTTCGGCTGAGTCCAGC<br>TCCTCCATGAACTCCAACACCCCGCTGGTGAGGATAACAACACGCCTCTCTTCAACG<br>GCAGACACCCCCATGCTGGCAGGGGTCTCCGAGTATGAACTTCCAGAGGACCCAAAA<br>TGGGAGTTTCCAAGAGATAAGCTGACACTGGGCAAGCCCCTGGGAGAAGGTTGCTTT<br>GGGCAAGTGGTCATGGCGGAAGCAGTGGGAATTGACAAAGACAAGCCCAAGGAGGCG<br>GTCACCGTGGCCGTGAAGATGTTGAAAGATGATGCCACAGAGAAAGACCTTTCTGAT<br>CTGGTGTCAGAGATGGAGATGATGAAGATGATTGGGAAACACAAGAATATCATAAAT<br>CTTCTTGGAGCCTGCACACAGGATGGGCCTCTCTATGTCATAGTTGAGTATGCCTCT<br>AAAGGCAACCTCCGAGAATACCTCCGAGCCCGGAGGCCACCCGGGATGGAGTACTCC<br>TATGACATTAACCGTGTTCCTGAGGAGCAGATGACCTTCAAGGACTTGGTGTCATGC<br>ACCTACCAGCTGGCCAGAGGCATGGAGTACTTGGCTTCCCAAAAATGTATTCATCGA<br>GATTTAGCAGCCAGAAATGTTTTGGTAACAGAAAACAATGTGATGAAAATAGCAGAC<br>TTTGGACTCGCCAGAGATATCAACAATATAGACTATTACAAAAAGACCACCAATGGG<br>CGGCTTCCAGTCAAGTGGATGGCTCCAGAAGCCCTGTTTGATAGAGTATACACTCAT<br>CAGAGTGATGTCTGGTCCTTCGGGGTGTTAATGTGGGAGATCTTCACTTTAGGGGGC<br>TCGCCCTACCCAGGGATTCCCGTGGAGGAACTTTTTAAGCTGCTGAAGGAAGGACAC<br>AGAATGGATAAGCCAGCCAACTGCACCAACGAACTGTACATGATGATGAGGGACTGT<br>TGGCATGCAGTGCCCTCCCAGAGACCAACGTTCAAGCAGTTGGTAGAAGACTTGGAT<br>CGAATTCTCACTCTCACAACCAATGAGGAATACTTGGACCTCAGCCAACCTCTCGAA<br>CAGTATTCACCTAGTTACCCTGACACAAGAAGTTCTTGTTCTTCAGGAGATGATTCT<br>GTTTTTCTCCAGACCCCATGCCTTACGAACCATGCCTTCCTCAGTATCCACACATA<br>AACGGCAGTGTTAAAACATGA |

TABLE 3-continued

| FGFR sequences | | |
|---|---|---|
| SEQ ID NO: 40 | FGFR2 isoform 11 Amino acid sequence | MVSWGRFICLVVVTMATLSLARPSFSLVEDTTLEPEEPPTKYQISQPEVYVAAPGES<br>LEVRCLLKDAAVISWTKDGVHLGPNNRTVLIGEYLQIKGATPRDSGLYACTASRTVD<br>SETWYFMVNVTDAISSGDDEDDTDGAEDFVSENSNNKRAPYWTNTEKMEKRLHAVPA<br>ANTVKFRCPAGGNPMPTMRWLKNGKEFKQEHRIGGYKVRNQHWSLIMESVVPSDKGN<br>YTCVVENEYGSINHTYHLDVVERSPHRPILQAGLPANASTVVGGDVEFVCKVYSDAQ<br>PHIQWIKHVEKNGSKYGPDGLPYLKVLKAAGVNTTDKEIEVLYIRNVTFEDAGEYTC<br>LAGNSIGISFHSAWLTVLPAPGREKEITASPDYLEIAIYCIGVFLIACMVVTVILCR<br>MKNTTKKPDFSSQPAVHKLTKRIPLRRQVSAESSSSMNSNTPLVRITTRLSSTADTP<br>MLAGVSEYELPEDPKWEFPRDKLTLGKPLGEGCFGQVVMAEAVGIDKDKPKEAVTVA<br>VKMLKDDATEKDLSDLVSEMEMMKMIGKHKNIINLLGACTQDGPLYV**IVEYASKGNL**<br>**R**EYLRARRPPGMEYSYDINRVPEEQMTFKDLVSCTYQLARGMEYLASQKCIHRDLAA<br>RNVLVTENNVMKIADFGLARDINNIDYYKKTTNGRLPVKWMAPEALFDRVYTHQSDV<br>WSFGVLMWEIFTLGGSPYPGIPVEELFKLLKEGHRMDKPANCTNELYMMMRDCWHAV<br>PSQRPTFKQLVEDLDRILTLTTNEEYLDLSQPLEQYSPSYPDTRSSCSSGDDSVFSP<br>DPMPYEPCLPQYPHINGSVKT |
| SEQ ID NO: 41 | FGFR3 isoform 1 Nucleic acid sequence | AGTGCGCGGTGGCGGCGGCGTCGCGGGCAGCTGGCGCCGCGCGGTCCTGCTCTGCCG<br>GTCGCACGGACGCACCGGCGGGCCGCCGGCCGGAGGGACGGGGCGGGAGCTGGGCCC<br>GCGGACAGCGAGCCGGAGCGGGAGCCGCGCGTAGCGAGCCGGGCTCCGGCGCTCGCC<br>AGTCTCCCGAGCGGCGCCCGCCTCCCGCCGGTGCCCGCGCCGGGCCGTGGGGGGCAG<br>CATGCCCGCGCGCGCTGCCTGAGGACGCCGCGGCCCCCGCCCCCGCCATGGGCGCCC<br>CTGCCTGCGCCCTCGCGCTCTGCGTGGCCGTGGCCATCGTGGCCGGCGCCTCCTCGG<br>AGTCCTTGGGGACGGAGCAGCGCGTCGTGGGGCGAGCGGCAGAAGTCCCGGGCCCAG<br>AGCCCGGCCAGCAGGAGCAGTTGGTCTTCGGCAGCGGGGATGCTGTGGAGCTGAGCT<br>GTCCCCCGCCCGGGGGTGGTCCCATGGGGCCCACTGTCTGGGTCAAGGATGGCACAG<br>GGCTGGTGCCCTCGGAGCGTGTCCTGGTGGGGCCCCAGCGGCTGCAGGTGCTGAATG<br>CCTCCCACGAGGACTCCGGGGCCTACAGCTGCCGGCAGCGGCTCACGCAGCGCGTAC<br>TGTGCCACTTCAGTGTGCGGGTGACAGACGCTCCATCCTCGGGAGATGACGAAGACG<br>GGGAGGACGAGGCTGAGGACACAGGTGTGGACACAGGGGCCCCTTACTGGACACGGC<br>CCGAGCGGATGGACAAGAAGCTGCTGGCCGTGCCGGCCGCCAACACCGTCCGCTTCC<br>GCTGCCCAGCCGCTGGCAACCCCACTCCCTCCATCTCCTGGCTGAAGAACGGCAGGG<br>AGTTCCGCGGCGAGCACCGCATTGGAGGCATCAAGCTGCGGCATCAGCAGTGGAGCC<br>TGGTCATGGAAAGCGTGGTGCCCTCGGACCGCGGCAACTACACCTGCGTCGTGGAGA<br>ACAAGTTTGGCAGCATCCGGCAGACGTACACGCTGGACGTGCTGGAGCGCTCCCCGC<br>ACCGGCCCATCCTGCAGGCGGGGCTGCCGGCCAACCAGACGGCGGTGCTGGGCAGCG<br>ACGTGGAGTTCCACTGCAAGGTGTACAGTGACGCACAGCCCCACATCCAGTGGCTCA<br>AGCACGTGGAGGTGAATGGCAGCAAGGTGGGCCCGGACGGCACACCCTACGTTACCG<br>TGCTCAAGACGGCGGGCGCTAACACCACCGACAAGGAGCTAGAGGTTCTCTCCTTGC<br>ACAACGTCACCTTTGAGGACGCCGGGGAGTACACCTGCCTGGCGGGCAATTCTATTG<br>GGTTTTCTCATCACTCTGCGTGGCTGGTGGTGCTGCCAGCCGAGGAGGAGCTGGTGG<br>AGGCTGACGAGGCGGGCAGTGTGTATGCAGGCATCCTCAGCTACGGGGTGGGCTTCT<br>TCCTGTTCATCCTGGTGGTGGCGGCTGTGACGCTCTGCCGCCTGCGCAGCCCCCCCA<br>AGAAAGGCCTGGGCTCCCCCACCGTGCACAAGATCTCCCGCTTCCCGCTCAAGCGAC<br>AGGTGTCCCTGGAGTCCAACGCGTCCATGAGCTCCAACACACCACTGGTGCGCATCG<br>CAAGGCTGTCCTCAGGGGAGGGCCCCACGCTGGCCAATGTCTCCGAGCTCGAGCTGC<br>CTGCCGACCCCAAATGGGAGCTGTCTCGGGCCCGGCTGACCCTGGGCAAGCCCCTTG<br>GGGAGGGCTGCTTCGGCCAGGTGGTCATGGCGGAGGCCATCGGCATTGACAAGGACC<br>GGGCCGCCAAGCCTGTCACCGTAGCCGTGAAGATGCTGAAAGACGATGCCACTGACA<br>AGGACCTGTCGGACCTGGTGTCTGAGATGGAGATGATGAAGATGATCGGGAAACACA<br>AAAACATCATCAACCTGCTGGGCGCCTGCACGCAGGGCGGGCCCCTGTACGTGCTGG<br>TGGAGTACGCGGCCAAGGGTAACCTGCGGGAGTTTCTGCGGGCGCGGCGGCCCCCGG<br>GCCTGGACTACTCCTTCGACACCTGCAAGCCGCCCGAGGAGCAGCTCACCTTCAAGG<br>ACCTGGTGTCCTGTGCCTACCAGGTGGCCCGGGGCATGGAGTACTTGGCCTCCCAGA<br>AGTGCATCCACAGGGACCTGGCTGCCCGCAATGTGCTGGTGACCGAGGACAACGTGA<br>TGAAGATCGCAGACTTCGGGCTGGCCCGGGACGTGCACAACCTCGACTACTACAAGA<br>AGACGACCAACGGCCGGCTGCCCGTGAAGTGGATGGCGCCTGAGGCCTTGTTTGACC<br>GAGTCTACACTCACCAGAGTGACGTCTGGTCCTTTGGGGTCCTGCTCTGGGAGATCT<br>TCACGCTGGGGGGCTCCCCGTACCCCGGCATCCCTGTGGAGGAGCTCTTCAAGCTGC<br>TGAAGGAGGGCCACCGCATGGACAAGCCCGCCAACTGCACACACGACCTGTACATGA<br>TCATGCGGGAGTGCTGGCATGCCGCGCCCTCCCAGAGGCCCACCTTCAAGCAGCTGG<br>TGGAGGACCTGGACCGTGTCCTTACCGTGACGTCCACCGACGAGTACCTGGACCTGT<br>CGGCGCCTTTCGAGCAGTACTCCCCGGGTGGCCAGGACACCCCCAGCTCCAGCTCCT<br>CAGGGGACGACTCCGTGTTTGCCCACGACCTGCTGCCCCCGGCCCCACCCAGCAGTG<br>GGGGCTCGCGGACGTGAAGGGCCACTGGTCCCCAACAATGTGAGGGGTCCCTAGCAG<br>CCCACCCTGCTGCTGGTGCACAGCCACTCCCCGGCATGAGACTCAGTGCAGATGGAG<br>AGACAGCTACACAGAGCTTTGGTCTGTGTGTGTGTGTGCGTGTGTGTGTGTGT<br>GTGCACATCCGCGTGTGCCTGTGTGCGTGCGCATCTTGCCTCCAGGTGCAGAGGTAC<br>CCTGGGTGTCCCCGCTGCTGTGCAACGGTCTCCTGACTGGTGCTGCAGCACCGAGGG<br>GCCTTTGTTCTGGGGGGACCCAGTGCAGAATGTAAGTGGGCCCACCCGGTGGGACCC<br>CCGTGGGGCAGGGAGCTGGGCCCGACATGGCTCCGGCCTCTGCCTTTGCACCACGGG<br>ACATCACAGGGTGGGCCTCGGCCCCTCCCACACCCAAAGCTGAGCCTGCAGGGAAGC<br>CCCACATGTCCAGCACCTTGTGCCTGGGGTGTTAGTGGCACCGCCTCCCCACCTCCA<br>GGCTTTCCCACTTCCCACCCTGCCCCTCAGAGACTGAAATTACGGGTACCTGAAGAT<br>GGGAGCCTTTACCTTTTATGCAAAAGGTTTATTCCGGAAACTAGTGTACATTTCTAT<br>AAATAGATGCTGTGTATATGGTATATATACATATATATATATAACATATATGGAAGA<br>GGAAAAGGCTGGTACAACGGAGGCCTGCGACCCTGGGGGCACAGGAGGCAGGCATGG<br>CCCTGGGCGGGGCGTGGGGGGGCGTGGAGGGAGGCCCCAGGGGGTCTCACCCATGCA |

TABLE 3-continued

| | | FGFR sequences |
|---|---|---|
| | | AGCAGAGGACCAGGGCCTTTTCTGGCACCGCAGTTTTGTTTTAAAACTGGACCTGTA<br>TATTTGTAAAGCTATTTATGGGCCCCTGGCACTCTTGTTCCCACACCCCAACACTTC<br>CAGCATTTAGCTGGCCACATGGCGGAGAGTTTTAATTTTTAACTTATTGACAACCGA<br>GAAGGTTTATCCCGCCGATAGAGGGACGGCCAAGAATGTACGTCCAGCCTGCCCCGG<br>AGCTGGAGGATCCCCTCCAAGCCTAAAAGGTTGTTAATAGTTGGAGGTGATTCCAGT<br>GAAGATATTTTATTTCCTTTGTCCTTTTTCAGGAGAATTAGATTTCTATAGGATTTT<br>TCTTTAGGAGATTTATTTTTTGGACTTCAAAGCAAGCTGGTATTTTCATACAAATTC<br>TTCTAATTGCTGTGTGTCCCAGGCAGGGAGACGGTTTCCAGGGAGGGGCCGGCCCTG<br>TGTGCAGGTTCCGATGTTATTAGATGTTACAAGTTTATATATATCTATATATATAAT<br>TTATTGAGTTTTTACAAGATGTATTTGTTGTAGACTTAACACTTCTTACGCAATGCT<br>TCTAGAGTTTTATAGCCTGGACTGCTACCTTTCAAAGCTTGGAGGGAAGCCGTGAAT<br>TCAGTTGGTTCGTTCTGTACTGTTACTGGGCCCTGAGTCTGGGCAGCTGTCCCTTGC<br>TTGCCTGCAGGGCCATGGCTCAGGGTGGTCTCTTCTTGGGGCCCAGTGCATGGTGGC<br>CAGAGGTGTCACCCAAACCGGCAGGTGCGATTTTGTTAACCCAGCGACGAACTTTCC<br>GAAAAATAAAGACACCTGGTTGCTAACCTGG |
| SEQ ID NO: 42 | FGFR3 isoform 1 Amino acid sequence | MGAPACALALCVAVAIVAGASSESLGTEQRVVGRAAEVPGPEPGQQEQLVFGSGDAV<br>ELSCPPPGGGPMGPTVWVKDGTGLVPSERVLVGPQRLQVLNASHEDSGAYSCRQRLT<br>QRVLCHFSVRVTDAPSSGDDEDGEDEAEDTGVDTGAPYWTRPERMDKKLLAVPAANT<br>VRFRCPAAGNPTPSISWLKNGREFRGEHRIGGIKLRHQQWSLVMESVVPSDRGNYTC<br>VVENKFGSIRQTYTLDVLERSPHRPILQAGLPANQTAVLGSDVEFHCKVYSDAQPHI<br>QWLKHVEVNGSKVGPDGTPYVTVLKTAGANTTDKELEVLSLHNVTFEDAGEYTCLAG<br>NSIGFSHHSAWLVVLPAEEELVEADEAGSVYAGILSYGVGFFLFILVVAAVTLCRLR<br>SPPKKGLGSPTVHKISRFPLKRQVSLESNASMSSNTPLVRIARLSSGEGPTLANVSE<br>LELPADPKWELSRARLTLGKPLGEGCFGQVVMAEAIGIDKDRAAKPVTVAVKMLKDD<br>ATDKDLSDLVSEMEMMKMIGKHKNIINLLGACTQGGPLYV**LVEYAAKGNLR**EFLRAR<br>RPPGLDYSFDTCKPPEEQLTFKDLVSCAYQVARGMEYLASQKCIHRDLAARNVLVTE<br>DNVMKIADFGLARDVHNLDYYKKTTNGRLPVKWMAPEALFDRVYTHQSDVWSFGVLL<br>WEIFTLGGSPYPGIPVEELFKLLKEGHRMDKPANCTHDLYMIMRECWHAAPSQRPTF<br>KQLVEDLDRVLTVTSTDEYLDLSAPFEQYSPGGQDTPSSSSSGDDSVFAHDLLPPAP<br>PSSGGSRT |
| SEQ ID NO: 43 | FGFR3 isoform 2 Nucleic acid sequence | GTCGCGGGCAGCTGGCGCCGCGCGGTCCTGCTCTGCCGGTCGCACGGACGCACCGGC<br>GGGCCGCCGGCCGGAGGGACGGGGCGGGAGCTGGGCCCGCGGACAGCGAGCCGGAGC<br>GGGAGCCGCGCGTAGCGAGCCGGGCTCCGGCGCTCGCCAGTCTCCCGAGCGGCGCCC<br>GCCTCCCGCCGGTGCCCGCGCCGGGCCGTGGGGGGCAGCATGCCCGCGCGCGCTGCC<br>TGAGGACGCCGCGGCCCCCGCCCCCGCCATGGGCGCCCCTGCCTGCGCCCTCGCGCT<br>CTGCGTGGCCGTGGCCATCGTGGCCGGCGCCTCCTCGGAGTCCTTGGGGACGGAGCA<br>GCGCGTCGTGGGGCGAGCGGCAGAAGTCCCGGGCCCAGAGCCCGGCCAGCAGGAGCA<br>GTTGGTCTTCGGCAGCGGGGATGCTGTGGAGCTGAGCTGTCCCCCGCCCGGGGGTGG<br>TCCCATGGGGCCCACTGTCTGGGTCAAGGATGGCACAGGGCTGGTGCCCTCGGAGCG<br>TGTCCTGGTGGGGCCCCAGCGGCTGCAGGTGCTGAATGCCTCCCACGAGGACTCCGG<br>GGCCTACAGCTGCCGGCAGCGGCTCACGCAGCGCGTACTGTGCCACTTCAGTGTGCG<br>GGTGACAGACGCTCCATCCTCGGGAGATGACGAAGACGGGGAGGACGAGGCTGAGGA<br>CACAGGTGTGGACACAGGGGCCCCTTACTGGACACGGCCCGAGCGGATGGACAAGAA<br>GCTGCTGGCCGTGCCGGCCGCCAACACCGTCCGCTTCCGCTGCCCAGCCGCTGGCAA<br>CCCCACTCCCTCCATCTCCTGGCTGAAGAACGGCAGGGAGTTCCGCGGCGAGCACCG<br>CATTGGAGGCATCAAGCTGCGGCATCAGCAGTGGAGCCTGGTCATGGAAAGCGTGGT<br>GCCCTCGGACCGCGGCAACTACACCTGCGTCGTGGAGAACAAGTTTGGCAGCATCCG<br>GCAGACGTACACGCTGGACGTGCTGGAGCGCTCCCCGCACCGGCCCATCCTGCAGGC<br>GGGGCTGCCGGCCAACCAGACGGCGGTGCTGGGCAGCGACGTGGAGTTCCACTGCAA<br>GGTGTACAGTGACGCACAGCCCCACATCCAGTGGCTCAAGCACGTGGAGGTGAATGG<br>CAGCAAGGTGGGCCCGGACGGCACACCCTACGTTACCGTGCTCAAGTCCTGGATCAG<br>TGAGAGTGTGGAGGCCGACGTGCGCCTCCGCCTGGCCAATGTGTCGGAGCGGGACGG<br>GGGCGAGTACCTCTGTCGAGCCACCAATTTCATAGGCGTGGCCGAGAAGGCCTTTTG<br>GCTGAGCGTTCACGGGCCCCGAGCAGCCGAGGAGGAGCTGGTGGAGGCTGACGAGGC<br>GGGCAGTGTGTATGCAGGCATCCTCAGCTACGGGGTGGGCTTCTTCCTGTTCATCCT<br>GGTGGTGGCGGCTGTGACGCTCTGCCGCCTGCGCAGCCCCCCCAAGAAAGGCCTGGG<br>CTCCCCCACCGTGCACAAGATCTCCCGCTTCCCGCTCAAGCGACAGGTGTCCCTGGA<br>GTCCAACGCGTCCATGAGCTCCAACACACCACTGGTGCGCATCGCAAGGCTGTCCTC<br>AGGGGAGGGCCCCACGCTGGCCAATGTCTCCGAGCTCGAGCTGCCTGCCGACCCCAA<br>ATGGGAGCTGTCTCGGGCCCGGCTGACCCTGGGCAAGCCCCTTGGGGAGGGCTGCTT<br>CGGCCAGGTGGTCATGGCGGAGGCCATCGGCATTGACAAGGACCGGGCCGCCAAGCC<br>TGTCACCGTAGCCGTGAAGATGCTGAAAGACGATGCCACTGACAAGGACCTGTCGGA<br>CCTGGTGTCTGAGATGGAGATGATGAAGATGATCGGGAAACACAAAAACATCATCAA<br>CCTGCTGGGCGCCTGCACGCAGGGCGGGCCCCTGTACGTGCTGGTGGAGTACGCGGC<br>CAAGGGTAACCTGCGGGAGTTTCTGCGGGCGCGGCGGCCCCCGGGCCTGGACTACTC<br>CTTCGACACCTGCAAGCCGCCCGAGGAGCAGCTCACCTTCAAGGACCTGGTGTCCTG<br>TGCCTACCAGGTGGCCCGGGGCATGGAGTACTTGGCCTCCCAGAAGTGCATCCACAG<br>GGACCTGGCTGCCCGCAATGTGCTGGTGACCGAGGACAACGTGATGAAGATCGCAGA<br>CTTCGGGCTGGCCCGGGACGTGCACAACCTCGACTACTACAAGAAGACGACCAACGG<br>CCGGCTGCCCGTGAAGTGGATGGCGCCTGAGGCCTTGTTTGACCGAGTCTACACTCA<br>CCAGAGTGACGTCTGGTCCTTTGGGGTCCTGCTCTGGGAGATCTTCACGCTGGGGGG<br>CTCCCCGTACCCCGGCATCCCTGTGGAGGAGCTCTTCAAGCTGCTGAAGGAGGGCCA<br>CCGCATGGACAAGCCCGCCAACTGCACACACGACCTGTACATGATCATGCGGGAGTG<br>CTGGCATGCCGCGCCCTCCCAGAGGCCCACCTTCAAGCAGCTGGTGGAGGACCTGGA<br>CCGTGTCCTTACCGTGACGTCCACCGACGAGTACCTGGACCTGTCGGCGCCTTTCGA<br>GCAGTACTCCCCGGGTGGCCAGGACACCCCCAGCTCCAGCTCCTCAGGGGACGACTC |

TABLE 3-continued

| FGFR sequences | | |
|---|---|---|
| | | CGTGTTTGCCCACGACCTGCTGCCCCCGGCCCCACCCAGCAGTGGGGGCTCGCGGAC<br>GTGAAGGGCCACTGGTCCCCAACAATGTGAGGGGTCCCTAGCAGCCCACCCTGCTGC<br>TGGTGCACAGCCACTCCCCGGCATGAGACTCAGTGCAGATGGAGAGACAGCTACACA<br>GAGCTTTGGTCTGTGTGTGTGTGTGTGCGTGTGTGTGTGTGTGTGCACATCCGCG<br>TGTGCCTGTGTGCGTGCGCATCTTGCCTCCAGGTGCAGAGGTACCCTGGGTGTCCCC<br>GCTGCTGTGCAACGGTCTCCTGACTGGTGCTGCAGCACCGAGGGGCCTTTGTTCTGG<br>GGGGACCCAGTGCAGAATGTAAGTGGGCCCACCCGGTGGGACCCCCGTGGGGCAGGG<br>AGCTGGGCCCGACATGGCTCCGGCCTCTGCCTTTGCACCACGGGACATCACAGGGTG<br>GGCCTCGGCCCCTCCCACACCCAAAGCTGAGCCTGCAGGGAAGCCCCACATGTCCAG<br>CACCTTGTGCCTGGGGTGTTAGTGGCACCGCCTCCCCACCTCCAGGCTTTCCCACTT<br>CCCACCCTGCCCCTCAGAGACTGAAATTACGGGTACCTGAAGATGGGAGCCTTTACC<br>TTTTATGCAAAAGGTTTATTCCGGAAACTAGTGTACATTTCTATAAATAGATGCTGT<br>GTATATGGTATATATACATATATATATATAACATATATGGAAGAGGAAAAGGCTGGT<br>ACAACGGAGGCCTGCGACCCTGGGGGCACAGGAGGCAGGCATGGCCCTGGGCGGGGC<br>GTGGGGGGGCGTGGAGGGAGGCCCCAGGGGGTCTCACCCATGCAAGCAGAGGACCAG<br>GGCCTTTTCTGGCACCGCAGTTTTGTTTTAAAACTGGACCTGTATATTTGTAAAGCT<br>ATTTATGGGCCCCTGGCACTCTTGTTCCCACACCCCAACACTTCCAGCATTTAGCTG<br>GCCACATGGCGGAGAGTTTTAATTTTTAACTTATTGACAACCGAGAAGGTTTATCCC<br>GCCGATAGAGGGACGGCCAAGAATGTACGTCCAGCCTGCCCCGGAGCTGGAGGATCC<br>CCTCCAAGCCTAAAAGGTTGTTAATAGTTGGAGGTGATTCCAGTGAAGATATTTTAT<br>TTCCTTTGTCCTTTTTCAGGAGAATTAGATTTCTATAGGATTTTTCTTTAGGAGATT<br>TATTTTTTGGACTTCAAAGCAAGCTGGTATTTTCATACAAATTCTTCTAATTGCTGT<br>GTGTCCCAGGCAGGGAGACGGTTTCCAGGGAGGGGCCGGCCCTGTGTGCAGGTTCCG<br>ATGTTATTAGATGTTACAAGTTTATATATATCTATATATATAATTTATTGAGTTTTT<br>ACAAGATGTATTTGTTGTAGACTTAACACTTCTTACGCAATGCTTCTAGAGTTTTAT<br>AGCCTGGACTGCTACCTTTCAAAGCTTGGAGGGAAGCCGTGAATTCAGTTGGTTCGT<br>TCTGTACTGTTACTGGGCCCTGAGTCTGGGCAGCTGTCCCTTGCTTGCCTGCAGGGC<br>CATGGCTCAGGGTGGTCTCTTCTTGGGGCCCAGTGCATGGTGGCCAGAGGTGTCACC<br>CAAACCGGCAGGTGCGATTTTGTTAACCCAGCGACGAACTTTCCGAAAAATAAAGAC<br>ACCTGGTTGCTAACCTGG |
| SEQ ID NO: 44 | FGFR3 isoform 2 Amino acid sequence | MGAPACALALCVAVAIVAGASSESLGTEQRVVGRAAEVPGPEPGQQEQLVFGSGDAV<br>ELSCPPPGGGPMGPTVWVKDGTGLVPSERVLVGPQRLQVLNASHEDSGAYSCRQRLT<br>QRVLCHFSVRVTDAPSSGDDEDGEDEAEDTGVDTGAPYWTRPERMDKKLLAVPAANT<br>VRFRCPAAGNPTPSISWLKNGREFRGEHRIGGIKLRHQQWSLVMESVVPSDRGNYTC<br>VVENKFGSIRQTYTLDVLERSPHRPILQAGLPANQTAVLGSDVEFHCKVYSDAQPHI<br>QWLKHVEVNGSKVGPDGTPYVTVLKSWISESVEADVRLRLANVSERDGGEYLCRATN<br>FIGVAEKAFWLSVHGPRAAEEELVEADEAGSVYAGILSYGVGFFLFILVVAAVTLCR<br>LRSPPKKGLGSPTVHKISRFPLKRQVSLESNASMSSNTPLVRIARLSSGEGPTLANV<br>SELELPADPKWELSRARLTLGKPLGEGCFGQVVMAEAIGIDKDRAAKPVTVAVKMLK<br>DDATDKDLSDLVSEMEMMKMIGKHKNIINLLGACTQGGPLYV**LVEYAAKGNLR**EFLR<br>ARRPPGLDYSFDTCKPPEEQLTFKDLVSCAYQVARGMEYLASQKCIHRDLAARNVLV<br>TEDNVMKIADFGLARDVHNLDYYKKTTNGRLPVKWMAPEALFDRVYTHQSDVWSFGV<br>LLWEIFTLGGSPYPGIPVEELFKLLKEGHRMDKPANCTHDLYMIMRECWHAAPSQRP<br>TFKQLVEDLDRVLTVTSTDEYLDLSAPFEQYSPGGQDTPSSSSSGDDSVFAHDLLPP<br>APPSSGGSRT |
| SEQ ID NO: 45 | FGFR3 isoform 3 Nucleic acid sequence | GTCGCGGGCAGCTGGCGCCGCGCGGTCCTGCTCTGCCGGTCGCACGGACGCACCGGC<br>GGGCCGCCGGCCGGAGGGACGGGGCGGGAGCTGGGCCCGCGGACAGCGAGCCGGAGC<br>GGGAGCCGCGCGTAGCGAGCCGGGCTCCGGCGCTCGCCAGTCTCCCGAGCGGCGCCC<br>GCCTCCCGCCGGTGCCCGCGCCGGGCCGTGGGGGGCAGCATGCCCGCGCGCGCTGCC<br>TGAGGACGCCGCGGCCCCCGCCCCCGCCATGGGCGCCCCTGCCTGCGCCCTCGCGCT<br>CTGCGTGGCCGTGGCCATCGTGGCCGGCGCCTCCTCGGAGTCCTTGGGGACGGAGCA<br>GCGCGTCGTGGGGCGAGCGGCAGAAGTCCCGGGCCCAGAGCCCGGCCAGCAGGAGCA<br>GTTGGTCTTCGGCAGCGGGGATGCTGTGGAGCTGAGCTGTCCCCCGCCCGGGGGTGG<br>TCCCATGGGGCCCACTGTCTGGGTCAAGGATGGCACAGGGCTGGTGCCCTCGGAGCG<br>TGTCCTGGTGGGGCCCCAGCGGCTGCAGGTGCTGAATGCCTCCCACGAGGACTCCGG<br>GGCCTACAGCTGCCGGCAGCGGCTCACGCAGCGCGTACTGTGCCACTTCAGTGTGCG<br>GGTGACAGACGCTCCATCCTCGGGAGATGACGAAGACGGGGAGGACGAGGCTGAGGA<br>CACAGGTGTGGACACAGGGGCCCCTTACTGGACACGGCCCGAGCGGATGGACAAGAA<br>GCTGCTGGCCGTGCCGGCCGCCAACACCGTCCGCTTCCGCTGCCCAGCCGCTGGCAA<br>CCCCACTCCCTCCATCTCCTGGCTGAAGAACGGCAGGGAGTTCCGCGGCGAGCACCG<br>CATTGGAGGCATCAAGCTGCGGCATCAGCAGTGGAGCCTGGTCATGGAAAGCGTGGT<br>GCCCTCGGACCGCGGCAACTACACCTGCGTCGTGGAGAACAAGTTTGGCAGCATCCG<br>GCAGACGTACACGCTGGACGTGCTGGAGCGCTCCCCGCACCGGCCCATCCTGCAGGC<br>GGGGCTGCCGGCCAACCAGACGGCGGTGCTGGGCAGCGACGTGGAGTTCCACTGCAA<br>GGTGTACAGTGACGCACAGCCCCACATCCAGTGGCTCAAGCACGTGGAGGTGAATGG<br>CAGCAAGGTGGGCCCGGACGGCACACCCTACGTTACCGTGCTCAAGGTGTCCCTGGA<br>GTCCAACGCGTCCATGAGCTCCAACACACCACTGGTGCGCATCGCAAGGCTGTCCTC<br>AGGGGAGGGCCCCACGCTGGCCAATGTCTCCGAGCTCGAGCTGCCTGCCGACCCCAA<br>ATGGGAGCTGTCTCGGGCCCGGCTGACCCTGGGCAAGCCCCTTGGGGAGGGCTGCTT<br>CGGCCAGGTGGTCATGGCGGAGGCCATCGGCATTGACAAGGACCGGGCCGCCAAGCC<br>TGTCACCGTAGCCGTGAAGATGCTGAAAGACGATGCCACTGACAAGGACCTGTCGGA<br>CCTGGTGTCTGAGATGGAGATGATGAAGATGATCGGGAAACACAAAAACATCATCAA<br>CCTGCTGGGCGCCTGCACGCAGGGCGGGCCCCTGTACGTGCTGGTGGAGTACGCGGC<br>CAAGGGTAACCTGCGGGAGTTTCTGCGGGCGCGGCGGCCCCCGGGCCTGGACTACTC<br>CTTCGACACCTGCAAGCCGCCCGAGGAGCAGCTCACCTTCAAGGACCTGGTGTCCTG<br>TGCCTACCAGGTGGCCCGGGGCATGGAGTACTTGGCCTCCCAGAAGTGCATCCACAG |

TABLE 3-continued

| FGFR sequences | | |
|---|---|---|
| | | GGACCTGGCTGCCCGCAATGTGCTGGTGACCGAGGACAACGTGATGAAGATCGCAGA<br>CTTCGGGCTGGCCCGGGACGTGCACAACCTCGACTACTACAAGAAGACGACCAACGG<br>CCGGCTGCCCGTGAAGTGGATGGCGCCTGAGGCCTTGTTTGACCGAGTCTACACTCA<br>CCAGAGTGACGTCTGGTCCTTTGGGGTCCTGCTCTGGGAGATCTTCACGCTGGGGGG<br>CTCCCCGTACCCCGGCATCCCTGTGGAGGAGCTCTTCAAGCTGCTGAAGGAGGGCCA<br>CCGCATGGACAAGCCCGCCAACTGCACACACGACCTGTACATGATCATGCGGGAGTG<br>CTGGCATGCCGCGCCCTCCCAGAGGCCCACCTTCAAGCAGCTGGTGGAGGACCTGGA<br>CCGTGTCCTTACCGTGACGTCCACCGACGAGTACCTGGACCTGTCGGCGCCTTTCGA<br>GCAGTACTCCCCGGGTGGCCAGGACACCCCCAGCTCCAGCTCCTCAGGGGACGACTC<br>CGTGTTTGCCCACGACCTGCTGCCCCCGGCCCCACCCAGCAGTGGGGGCTCGCGGAC<br>GTGAAGGGCCACTGGTCCCCAACAATGTGAGGGGTCCCTAGCAGCCCACCCTGCTGC<br>TGGTGCACAGCCACTCCCCGGCATGAGACTCAGTGCAGATGGAGAGACAGCTACACA<br>GAGCTTTGGTCTGTGTGTGTGTGTGTGCGTGTGTGTGTGTGTGTGCACATCCGCG<br>TGTGCCTGTGTGCGTGCGCATCTTGCCTCCAGGTGCAGAGGTACCCTGGGTGTCCCC<br>GCTGCTGTGCAACGGTCTCCTGACTGGTGCTGCAGCACCGAGGGGCCTTTGTTCTGG<br>GGGGACCCAGTGCAGAATGTAAGTGGGCCCACCCGGTGGGACCCCCGTGGGGCAGGG<br>AGCTGGGCCCGACATGGCTCCGGCCTCTGCCTTTGCACCACGGGACATCACAGGGTG<br>GGCCTCGGCCCCTCCCACACCCAAAGCTGAGCCTGCAGGGAAGCCCCACATGTCCAG<br>CACCTTGTGCCTGGGGTGTTAGTGGCACCGCCTCCCCACCTCCAGGCTTTCCCACTT<br>CCCACCCTGCCCCTCAGAGACTGAAATTACGGGTACCTGAAGATGGGAGCCTTTACC<br>TTTTATGCAAAAGGTTTATTCCGGAAACTAGTGTACATTTCTATAAATAGATGCTGT<br>GTATATGGTATATATACATATATATATATAACATATATGGAAGAGGAAAAGGCTGGT<br>ACAACGGAGGCCTGCGACCCTGGGGGCACAGGAGGCAGGCATGGCCCTGGGCGGGGC<br>GTGGGGGGGCGTGGAGGGAGGCCCCAGGGGGTCTCACCCATGCAAGCAGAGGACCAG<br>GGCCTTTTCTGGCACCGCAGTTTTGTTTTAAAACTGGACCTGTATATTTGTAAAGCT<br>ATTTATGGGCCCCTGGCACTCTTGTTCCCACACCCCAACACTTCCAGCATTTAGCTG<br>GCCACATGGCGGAGAGTTTTAATTTTTAACTTATTGACAACCGAGAAGGTTTATCCC<br>GCCGATAGAGGGACGGCCAAGAATGTACGTCCAGCCTGCCCCGGAGCTGGAGGATCC<br>CCTCCAAGCCTAAAAGGTTGTTAATAGTTGGAGGTGATTCCAGTGAAGATATTTTAT<br>TTCCTTTGTCCTTTTTCAGGAGAATTAGATTTCTATAGGATTTTTCTTTAGGAGATT<br>TATTTTTTGGACTTCAAAGCAAGCTGGTATTTTCATACAAATTCTTCTAATTGCTGT<br>GTGTCCCAGGCAGGGAGACGGTTTCCAGGGAGGGGCCGGCCCTGTGTGCAGGTTCCG<br>ATGTTATTAGATGTTACAAGTTTATATATATCTATATATATAATTTATTGAGTTTTT<br>ACAAGATGTATTTGTTGTAGACTTAACACTTCTTACGCAATGCTTCTAGAGTTTTAT<br>AGCCTGGACTGCTACCTTTCAAAGCTTGGAGGGAAGCCGTGAATTCAGTTGGTTCGT<br>TCTGTACTGTTACTGGGCCCTGAGTCTGGGCAGCTGTCCCTTGCTTGCCTGCAGGGC<br>CATGGCTCAGGGTGGTCTCTTCTTGGGGCCCAGTGCATGGTGGCCAGAGGTGTCACC<br>CAAACCGGCAGGTGCGATTTTGTTAACCCAGCGACGAACTTTCCGAAAAATAAAGAC<br>ACCTGGTTGCTAACCTGG |
| SEQ ID NO: 46 | FGFR3 isoform 3 Amino acid sequence | MGAPACALALCVAVAIVAGASSESLGTEQRVVGRAAEVPGPEPGQQEQLVFGSGDAV<br>ELSCPPPGGGPMGPTVWVKDGTGLVPSERVLVGPQRLQVLNASHEDSGAYSCRQRLT<br>QRVLCHFSVRVTDAPSSGDDEDGEDEAEDTGVDTGAPYWTRPERMDKKLLAVPAANT<br>VRFRCPAAGNPTPSISWLKNGREFRGEHRIGGIKLRHQQWSLVMESVVPSDRGNYTC<br>VVENKFGSIRQTYTLDVLERSPHRPILQAGLPANQTAVLGSDVEFHCKVYSDAQPHI<br>QWLKHVEVNGSKVGPDGTPYVTVLKVSLESNASMSSNTPLVRIARLSSGEGPTLANV<br>SELELPADPKWELSRARLTLGKPLGEGCFGQVVMAEAIGIDKDRAAKPVTVAVKMLK<br>DDATDKDLSDLVSEMEMMKMIGKHKNIINLLGACTQGGPLYV**LVEYAAKGNLR**EFLR<br>ARRPPGLDYSFDTCKPPEEQLTFKDLVSCAYQVARGMEYLASQKCIHRDLAARNVLV<br>TEDNVMKIADFGLARDVHNLDYYKKTTNGRLPVKWMAPEALFDRVYTHQSDVWSFGV<br>LLWEIFTLGGSPYPGIPVEELFKLLKEGHRMDKPANCTHDLYMIMRECWHAAPSQRP<br>TFKQLVEDLDRVLTVTSTDEYLDLSAPFEQYSPGGQDTPSSSSSGDDSVFAHDLLPP<br>APPSSGGSRT |
| SEQ ID NO: 47 | FGFR3 isoform 4 Nucleic acid sequence | CGCGCGCTGCCTGAGGACGCCGCGGCCCCCGCCCCCGCCATGGGCGCCCCTGCCTGC<br>GCCCTCGCGCTCTGCGTGGCCGTGGCCATCGTGGCCGGCGCCTCCTCGGAGTCCTTG<br>GGGACGGAGCAGCGCGTCGTGGGGCGAGCGGCAGAAGTCCCGGGCCCAGAGCCCGGC<br>CAGCAGGAGCAGTTGGTCTTCGGCAGCGGGGATGCTGTGGAGCTGAGCTGTCCCCCG<br>CCCGGGGGTGGTCCCATGGGGCCCACTGTCTGGGTCAAGGATGGCACAGGGCTGGTG<br>CCCTCGGAGCGTGTCCTGGTGGGGCCCCAGCGGCTGCAGGTGCTGAATGCCTCCCAC<br>GAGGACTCCGGGGCCTACAGCTGCCGGCAGCGGCTCACGCAGCGCGTACTGTGCCAC<br>TTCAGTGTGCGGGTGACAGACGCTCCATCCTCGGGAGATGACGAAGACGGGGAGGAC<br>GAGGCTGAGGACACAGGTGTGGACACAGGGGCCCCTTACTGGACACGGCCCGAGCGG<br>ATGGACAAGAAGCTGCTGGCCGTGCCGGCCGCCAACACCGTCCGCTTCCGCTGCCCA<br>GCCGCTGGCAACCCCACTCCCTCCATCTCCTGGCTGAAGAACGGCAGGGAGTTCCGC<br>GGCGAGCACCGCATTGGAGGCATCAAGCTGCGGCATCAGCAGTGGAGCCTGGTCATG<br>GAAAGCGTGGTGCCCTCGGACCGCGGCAACTACACCTGCGTCGTGGAGAACAAGTTT<br>GGCAGCATCCGGCAGACGTACACGCTGGACGTGCTGGAGCGCTCCCCGCACCGGCCC<br>ATCCTGCAGGCGGGGCTGCCGGCCAACCAGACGGCGGTGCTGGGCAGCGACGTGGAG<br>TTCCACTGCAAGGTGTACAGTGACGCACAGCCCCACATCCAGTGGCTCAAGCACGTG<br>GAGGTGAATGGCAGCAAGGTGGGCCCGGACGGCACACCCTACGTTACCGTGCTCAAG<br>GTGTCCCTGGAGTCCAACGCGTCCATGAGCTCCAACACACCACTGGTGCGCATCGCA<br>AGGCTGTCCTCAGGGGAGGGCCCCACGCTGGCCAATGTCTCCGAGCTCGAGCTGCCT<br>GCCGACCCCAAATGGGAGCTGTCTCGGGCCCGGCTGACCCTGGGCAAGCCCCTTGGG<br>GAGGGCTGCTTCGGCCAGGTGGTCATGGCGGAGGCCATCGGCATTGACAAGGACCGG<br>GCCGCCAAGCCTGTCACCGTAGCCGTGAAGATGCTGAAAGACGATGCCACTGACAAG<br>GACCTGTCGGACCTGGTGTCTGAGATGGAGATGATGAAGATGATCGGGAAACACAAA<br>AACATCATCAACCTGCTGGGCGCCTGCACGCAGGGCGGGCCCCTGTACGTGCTGGTG |

TABLE 3-continued

| FGFR sequences | | |
|---|---|---|
| | | GAGTACGCGGCCAAGGGTAACCTGCGGGAGTTTCTGCGGGCGCGGCGGCCCCCGGGC<br>CTGGACTACTCCTTCGACACCTGCAAGCCGCCCGAGGAGCAGCTCACCTTCAAGGAC<br>CTGGTGTCCTGTGCCTACCAGGTGGCCCGGGGCATGGAGTACTTGGCCTCCCAGAAG<br>TGCATCCACAGGGACCTGGCTGCCCGCAATGTGCTGGTGACCGAGGACAACGTGATG<br>AAGATCGCAGACTTCGGGCTGGCCCGGGACGTGCACAACCTCGACTACTACAAGAAG<br>ACGACCAACGGCCGGCTGCCCGTGAAGTGGATGGCGCCTGAGGCCTTGTTTGACCGA<br>GTCTACACTCACCAGAGTGACGTCTGGTCCTTTGGGGTCCTGCTCTGGGAGATCTTC<br>ACGCTGGGGGGCTCCCCGTACCCCGGCATCCCTGTGGAGGAGCTCTTCAAGCTGCTG<br>AAGGAGGGCCACCGCATGGACAAGCCCGCCAACTGCACACACGACCTGTACATGATC<br>ATGCGGGAGTGCTGGCATGCCGCGCCCTCCCAGAGGCCCACCTTCAAGCAGCTGGTG<br>GAGGACCTGGACCGTGTCCTTACCGTGACGTCCACCGACGAGTACCTGGACCTGTCG<br>GCGCCTTTCGAGCAGTACTCCCCGGGTGGCCAGGACACCCCCAGCTCCAGCTCCTCA<br>GGGGACGACTCCGTGTTTGCCCACGACCTGCTGCCCCCGGCCCCACCCAGCAGTGGG<br>GGCTCGCGGACGTGAAGGGCCACTGGTCCCCAACAATGTGAGGGGTCCCTAGCAGCC<br>CACCCTGCTGCTGGTGCA |
| SEQ ID NO: 48 | FGFR3 isoform 4 Amino acid sequence | MGAPACALALCVAVAIVAGASSESLGTEQRVVGRAAEVPGPEPGQQEQLVFGSGDAV<br>ELSCPPPGGGPMGPTVWVKDGTGLVPSERVLVGPQRLQVLNASHEDSGAYSCRQRLT<br>QRVLCHFSVRVTDAPSSGDDEDGEDEAEDTGVDTGAPYWTRPERMDKKLLAVPAANT<br>VRFRCPAAGNPTPSISWLKNGREFRGEHRIGGIKLRHQQWSLVMESVVPSDRGNYTC<br>VVENKFGSIRQTYTLDVLERSPHRPILQAGLPANQTAVLGSDVEFHCKVYSDAQPHI<br>QWLKHVEVNGSKVGPDGTPYVTVLKVSLESNASMSSNTPLVRIARLSSGEGPTLANV<br>SELELPADPKWELSRARLTLGKPLGEGCFGQVVMAEAIGIDKDRAAKPVTVAVKMLK<br>DDATDKDLSDLVSEMEMMKMIGKHKNIINLLGACTQGGPLYV**LVEYAAKGNLR**EFLR<br>ARRPPGLDYSFDTCKPPEEQLTFKDLVSCAYQVARGMEYLASQKCIHRDLAARNVLV<br>TEDNVMKIADFGLARDVHNLDYYKKTTNGRLPVKWMAPEALFDRVYTHQSDVWSFGV<br>LLWEIFTLGGSPYPGIPVEELFKLLKEGHRMDKPANCTHDLYMIMRECWHAAPSQRP<br>TFKQLVEDLDRVLTVTSTDEYLDLSAPFEQYSPGGQDTPSSSSSGDDSVFAHDLLPP<br>APPSSGGSRT |
| SEQ ID NO: 49 | FGFR4 isoform 1 Nucleic acid sequence | CGCTCGCGGCCACGCCGCCGTCGCGGGTACATTCCTCGCTCCCGGCCGAGGAGCGCT<br>CGGGCTGTCTGCGGACCCTGCCGCGTGCAGGGGTCGCGGCCGGCTGGAGCTGGGAGT<br>GAGGCGGCGGAGGAGCCAGGTGAGGAGGAGCCAGGTGAGCAGGACCCTGTGCTGGGC<br>GCGGAGTCACGCAGGCTCGAGGAAGGCAGTTGGTGGGAAGTCCAGCTTGGGTCCCTG<br>AGAGCTGTGAGAAGGAGATGCGGCTGCTGCTGGCCCTGTTGGGGGTCCTGCTGAGTG<br>TGCCTGGGCCTCCAGTCTTGTCCCTGGAGGCCTCTGAGGAAGTGGAGCTTGAGCCCT<br>GCCTGGCTCCCAGCCTGGAGCAGCAAGAGCAGGAGCTGACAGTAGCCCTTGGGCAGC<br>CTGTGCGTCTGTGCTGTGGGCGGGCTGAGCGTGGTGGCCACTGGTACAAGGAGGGCA<br>GTCGCCTGGCACCTGCTGGCCGTGTACGGGGCTGGAGGGGCCGCCTAGAGATTGCCA<br>GCTTCCTACCTGAGGATGCTGGCCGCTACCTCTGCCTGGCACGAGGCTCCATGATCG<br>TCCTGCAGAATCTCACCTTGATTACAGGTGACTCCTTGACCTCCAGCAACGATGATG<br>AGGACCCCAAGTCCCATAGGGACCCCTCGAATAGGCACAGTTACCCCCAGCAAGCAC<br>CCTACTGGACACACCCCCAGCGCATGGAGAAGAAACTGCATGCAGTACCTGCGGGGA<br>ACACCGTCAAGTTCCGCTGTCCAGCTGCAGGCAACCCCACGCCCACCATCCGCTGGC<br>TTAAGGATGGACAGGCCTTTCATGGGGAGAACCGCATTGGAGGCATTCGGCTGCGCC<br>ATCAGCACTGGAGTCTCGTGATGGAGAGCGTGGTGCCCTCGGACCGCGGCACATACA<br>CCTGCCTGGTAGAGAACGCTGTGGGCAGCATCCGCTATAACTACCTGCTAGATGTGC<br>TGGAGCGGTCCCCGCACCGGCCCATCCTGCAGGCCGGGCTCCCGGCCAACACCACAG<br>CCGTGGTGGGCAGCGACGTGGAGCTGCTGTGCAAGGTGTACAGCGATGCCCAGCCCC<br>ACATCCAGTGGCTGAAGCACATCGTCATCAACGGCAGCAGCTTCGGAGCCGACGGTT<br>TCCCCTATGTGCAAGTCCTAAAGACTGCAGACATCAATAGCTCAGAGGTGGAGGTCC<br>TGTACCTGCGGAACGTGTCAGCCGAGGACGCAGGCGAGTACACCTGCCTCGCAGGCA<br>ATTCCATCGGCCTCTCCTACCAGTCTGCCTGGCTCACGGTGCTGCCAGAGGAGGACC<br>CCACATGGACCGCAGCAGCGCCCGAGGCCAGGTATACGGACATCATCCTGTACGCGT<br>CGGGCTCCCTGGCCTTGGCTGTGCTCCTGCTGCTGGCCGGGCTGTATCGAGGGCAGG<br>CGCTCCACGGCCGGCACCCCCGCCCGCCCGCCACTGTGCAGAAGCTCTCCCGCTTCC<br>CTCTGGCCCGACAGTTCTCCCTGGAGTCAGGCTCTTCCGGCAAGTCAAGCTCATCCC<br>TGGTACGAGGCGTGCGTCTCTCCTCCAGCGGCCCCGCCTTGCTCGCCGGCCTCGTGA<br>GTCTAGATCTACCTCTCGACCCACTATGGGAGTTCCCCCGGGACAGGCTGGTGCTTG<br>GGAAGCCCCTAGGCGAGGGCTGCTTTGGCCAGGTAGTACGTGCAGAGGCCTTTGGCA<br>TGGACCCTGCCCGGCCTGACCAAGCCAGCACTGTGGCCGTCAAGATGCTCAAAGACA<br>ACGCCTCTGACAAGGACCTGGCCGACCTGGTCTCGGAGATGGAGGTGATGAAGCTGA<br>TCGGCCGACACAAGAACATCATCAACCTGCTTGGTGTCTGCACCCAGGAAGGGCCCC<br>TGTACGTGATCGTGGAGTGCGCCGCCAAGGGAAACCTGCGGGAGTTCCTGCGGGCCC<br>GGCGCCCCCCAGGCCCCGACCTCAGCCCCGACGGTCCTCGGAGCAGTGAGGGGCCGC<br>TCTCCTTCCCAGTCCTGGTCTCCTGCGCCTACCAGGTGGCCCGAGGCATGCAGTATC<br>TGGAGTCCCGGAAGTGTATCCACCGGGACCTGGCTGCCCGCAATGTGCTGGTGACTG<br>AGGACAATGTGATGAAGATTGCTGACTTTGGGCTGGCCCGCGGCGTCCACCACATTG<br>ACTACTATAAGAAAACCAGCAACGGCCGCCTGCCTGTGAAGTGGATGGCGCCCGAGG<br>CCTTGTTTGACCGGGTGTACACACACCAGAGTGACGTGTGGTCTTTTGGGATCCTGC<br>TATGGGAGATCTTCACCCTCGGGGGCTCCCCGTATCCTGGCATCCCGGTGGAGGAGC<br>TGTTCTCGCTGCTGCGGGAGGGACATCGGATGGACCGACCCCCACACTGCCCCCCAG<br>AGCTGTACGGGCTGATGCGTGAGTGCTGGCACGCAGCGCCCTCCCAGAGGCCTACCT<br>TCAAGCAGCTGGTGGAGGCGCTGGACAAGGTCCTGCTGGCCGTCTCTGAGGAGTACC<br>TCGACCTCCGCCTGACCTTCGGACCCTATTCCCCCTCTGGTGGGGACGCCAGCAGCA<br>CCTGCTCCTCCAGCGATTCTGTCTTCAGCCACGACCCCCTGCCATTGGGATCCAGCT<br>CCTTCCCCTTCGGGTCTGGGGTGCAGACATGAGCAAGGCTCAAGGCTGTGCAGGCAC<br>ATAGGCTGGTGGCCTTGGGCCTTGGGGCTCAGCCACAGCCTGACACAGTGCTCGACC |

TABLE 3-continued

| FGFR sequences | | |
|---|---|---|
| | | TTGATAGCATGGGGCCCCTGGCCCAGAGTTGCTGTGCCGTGTCCAAGGGCCGTGCCC<br>TTGCCCTTGGAGCTGCCGTGCCTGTGTCCTGATGGCCCAAATGTCAGGGTTCTGCTC<br>GGCTTCTTGGACCTTGGCGCTTAGTCCCCATCCCGGGTTTGGCTGAGCCTGGCTGGA<br>GAGCTGCTATGCTAAACCTCCTGCCTCCCAATACCAGCAGGAGGTTCTGGGCCTCTG<br>AACCCCCTTTCCCCACACCTCCCCCTGCTGCTGCTGCCCCAGCGTCTTGACGGGAGC<br>ATTGGCCCCTGAGCCCAGAGAAGCTGGAAGCCTGCCGAAAACAGGAGCAAATGGCGT<br>TTTATAAATTATTTTTTTGAAATAAAGCTCTGTGTGCCTGGGTC |
| SEQ ID NO: 50 | FGFR4 isoform 1 Amino acid sequence | MRLLLALLGVLLSVPGPPVLSLEASEEVELEPCLAPSLEQQEQELTVALGQPVRLCC<br>GRAERGGHWYKEGSRLAPAGRVRGWRGRLEIASFLPEDAGRYLCLARGSMIVLQNLT<br>LITGDSLTSSNDDEDPKSHRDPSNRHSYPQQAPYWTHPQRMEKKLHAVPAGNTVKFR<br>CPAAGNPTPTIRWLKDGQAFHGENRIGGIRLRHQHWSLVMESVVPSDRGTYTCLVEN<br>AVGSIRYNYLLDVLERSPHRPILQAGLPANTTAVVGSDVELLCKVYSDAQPHIQWLK<br>HIVINGSSFGADGFPYVQVLKTADINSSEVEVLYLRNVSAEDAGEYTCLAGNSIGLS<br>YQSAWLTVLPEEDPTWTAAAPEARYTDIILYASGSLALAVLLLLAGLYRGQALHGRH<br>PRPPATVQKLSRFPLARQFSLESGSSGKSSSSLVRGVRLSSSGPALLAGLVSLDLPL<br>DPLWEFPRDRLVLGKPLGEGCFGQVVRAEAFGMDPARPDQASTVAVKMLKDNASDKD<br>LADLVSEMEVMKLIGRHKNIINLLGVCTQEGPLYV**IVECAAKGNLR**EFLRARRPPGP<br>DLSPDGPRSSEGPLSFPVLVSCAYQVARGMQYLESRKCIHRDLAARNVLVTEDNVMK<br>IADFGLARGVHHIDYYKKTSNGRLPVKWMAPEALFDRVYTHQSDVWSFGILLWEIFT<br>LGGSPYPGIPVEELFSLLREGHRMDRPPHCPPELYGLMRECWHAAPSQRPTFKQLVE<br>ALDKVLLAVSEEYLDLRLTFGPYSPSGGDASSTCSSSDSVFSHDPLPLGSSSFPFGS<br>GVQT |
| SEQ ID NO: 51 | FGFR4 isoform 2 Nucleic acid sequence | GTCGCGGGTACATTCCTCGCTCCCGGCCGAGGAGCGCTCGGGCTGTCTGCGGACCCT<br>GCCGCGTGCAGGGGTCGCGGCCGGCTGGAGCTGGGAGTGAGGCGGCGGAGGAGCCAG<br>GTGAGGAGGAGCCAGGAAGGCAGTTGGTGGGAAGTCCAGCTTGGGTCCCTGAGAGCT<br>GTGAGAAGGAGATGCGGCTGCTGCTGGCCCTGTTGGGGGTCCTGCTGAGTGTGCCTG<br>GGCCTCCAGTCTTGTCCCTGGAGGCCTCTGAGGAAGTGGAGCTTGAGCCCTGCCTGG<br>CTCCCAGCCTGGAGCAGCAAGAGCAGGAGCTGACAGTAGCCCTTGGGCAGCCTGTGC<br>GTCTGTGCTGTGGGCGGGCTGAGCGTGGTGGCCACTGGTACAAGGAGGGCAGTCGCC<br>TGGCACCTGCTGGCCGTCTACGGGGCTGGAGGGGCCGCCTAGAGATTGCCAGCTTCC<br>TACCTGAGGATGCTGGCCGCTACCTCTGCCTGGCACGAGGCTCCATGATCGTCCTGC<br>AGAATCTCACCTTGATTACAGGTGACTCCTTGACCTCCAGCAACGATGATGAGGACC<br>CCAAGTCCCATAGGGACCCCTCGAATAGGCACAGTTACCCCCAGCAAGCACCCTACT<br>GGACACACCCCCAGCGCATGGAGAAGAAACTGCATGCAGTACCTGCGGGGAACACCG<br>TCAAGTTCCGCTGTCCACCTGCAGGCAACCCCACGCCCACCATCCGCTGGCTTAAGG<br>ATGGACAGGCCTTTCATCGGGAGAACCGCATTGGAGGCATTCGGCTGCGCCATCAGC<br>ACTGGAGTCTCGTGATGCAGAGCGTGGTGCCCTCGGACCGCGGCACATACACCTGCC<br>TGGTAGAGAACGCTGTGCGCAGCATCCGCTATAACTACCTGCTAGATGTGCTGGAGC<br>GGTCCCCGCACCGGCCCATCCTGCAGGCCGGGCTCCCGGCCAACACCACAGCCGTGG<br>TGGGCAGCGACGTGGAGCTGCTGTGCAAGGTGTACAGCGATGCCCAGCCCCACATCC<br>AGTGGCTGAAGCACATCCTCATCAACGGCAGCAGCTTCGGAGCCGACGGTTTCCCCT<br>ATGTGCAAGTCCTAAAGACTGCAGACATCAATAGCTCAGAGGTGGAGGTCCTGTACC<br>TGCGGAACGTGTCAGCCCAGGACGCAGGCGAGTACACCTGCCTCGCAGGCAATTCCA<br>TCGGCCTCTCCTACCAGTCTGCCTGGCTCACGGTGCTGCCAGAGGAGGACCCCACAT<br>GGACCGCAGCAGCGCCCCAGGCCAGTTCTCCCTGGAGTCAGGCTCTTCCGGCAAGTC<br>AAGCTCATCCCTGGTACCAGGCGTGCGTCTCTCCTCCAGCGGCCCCGCCTTGCTCGC<br>CGGCCTCGCTGGTGCTTCGGAAGCCCCTAGGCGAGGGCTGCTTTGGCCAGGTAGTAC<br>GTGCAGAGGCCTTTGGCATGGACCCTGCCCGGCCTGACCAAGCCAGCACTGTGGCCG<br>TCAAGATGCTCAAAGACAACGCCTCTGACAAGGACCTGGCCGACCTGGTCTCGGAGA<br>TGGAGGTGATGAAGCTGATCGGCCGACACAAGAACATCATCAACCTGCTTGGTGTCT<br>GCACCCAGGAAGGGCCCCTGTACGTGATCGTGGAGTGCGCCGCCAAGGGAAACCTGC<br>GGGAGTTCCTGCGGGCCCGGCGCCCCCCAGGCCCCGACCTCAGCCCCGACGGTCCTC<br>GGAGCAGTGAGGGGCCGCTCTCCTTCCCAGTCCTGGTCTCCTGCGCCTACCAGGTGG<br>CCCGAGGCATGCAGTATCTGGAGTCCCGGAAGTGTATCCACCGGGACCTGGCTGCCC<br>GCAATGTGCTGGTGACTCAGGACAATGTGATGAAGATTGCTGACTTTGGGCTGGCCC<br>GCGGCGTCCACCACATTCACTACTATAAGAAAACCAGCAACGGCCGCCTGCCTGTGA<br>AGTGGATGGCGCCCGAGCCCTTGTTTGACCGGGTGTACACACACCAGAGTGACGTGT<br>GGTCTTTTGGGATCCTGCTATGGGAGATCTTCACCCTCGGGGGCTCCCCGTATCCTG<br>GCATCCCGGTGGAGGAGCTGTTCTCGCTGCTGCGGGAGGGACATCGGATGGACCGAC<br>CCCCACACTGCCCCCCACAGCTGTACGGGCTGATGCGTGAGTGCTGGCACGCAGCGC<br>CCTCCCAGAGGCCTACCTTCAAGCAGCTGGTGGAGGCGCTGGACAAGGTCCTGCTGG<br>CCGTCTCTGAGGAGTACCTCGACCTCCGCCTGACCTTCGGACCCTATTCCCCCTCTG<br>GTGGGGACGCCAGCAGCACCTGCTCCTCCAGCGATTCTGTCTTCAGCCACGACCCCC<br>TGCCATTGGGATCCAGCTCCTTCCCCTTCGGGTCTGGGGTGCAGACATGAGCAAGGC<br>TCAAGGCTGTGCAGGCACATAGGCTGGTGGCCTTGGGCCTTGGGGCTCAGCCACAGC<br>CTGACACAGTGCTCGACCTTGATAGCATGGGGCCCCTGGCCCAGAGTTGCTGTGCCG<br>TGTCCAAGGGCCGTGCCCTTGCCCTTGGAGCTGCCGTGCCTGTGTCCTGATGGCCCA<br>AATGTCAGGGTTCTGCTCGGCTTCTTGGACCTTGGCGCTTAGTCCCCATCCCGGGTT<br>TGGCTGAGCCTGGCTGGAGAGCTGCTATGCTAAACCTCCTGCCTCCCAATACCAGCA<br>GGAGGTTCTGGGCCTCTGAACCCCCTTTCCCCACACCTCCCCCTGCTGCTGCTG |
| SEQ ID NO: 52 | FGFR4 isoform 2 Amino acid sequence | MRLLLALLGVLLSVPGPPVLSLEASEEVELEPCLAPSLEQQEQELTVALGQPVRLCC<br>GRAERGGHWYKEGSRLAPAGRVRGWRGRLEIASFLPEDAGRYLCLARGSMIVLQNLT<br>LITGDSLTSSNDDEDPKSHRDPSNRHSYPQQAPYWTHPQRMEKKLHAVPAGNTVKFR<br>CPAAGNPTPTIRWLKDGQAFHGENRIGGIRLRHQHWSLVMESVVPSDRGTYTCLVEN<br>AVGSIRYNYLLDVLERSPHRPILQAGLPANTTAVVGSDVELLCKVYSDAQPHIQWLK |

TABLE 3-continued

| FGFR sequences | | |
|---|---|---|
| | | HIVINGSSFGADGFPYVQVLKTADINSSEVEVLYLRNVSAEDAGEYTCLAGNSIGLS<br>YQSAWLTVLPEEDPTWTAAAPEASSPWSQALPASQAHPWYEACVSPPAAPPCSPASL<br>VLGKPLGEGCFGQVVRAEAFGMDPARPDQASTVAVKMLKDNASDKDLADLVSEMEVM<br>KLIGRHKNIINLLGVCTQEGPLYV**IVECAAKGNLR**EFLRARRPPGPDLSPDGPRSSE<br>GPLSFPVLVSCAYQVARGMQYLESRKCIHRDLAARNVLVTEDNVMKIADFGLARGVH<br>HIDYYKKTSNGRLPVKWMAPEALFDRVYTHQSDVWSFGILLWEIFTLGGSPYPGIPV<br>EELFSLLREGHRMDRPPHCPPELYGLMRECWHAAPSQRPTFKQLVEALDKVLLAVSE<br>EYLDLRLTFGPYSPSGGDASSTCSSSDSVFSHDPLPLGSSSFPFGSGVQT |
| SEQ ID NO: 53 | FGFR4 isoform 3 Nucleic acid sequence | ACATTCCTCGCTCCCGGCCGAGGAGCGCTCGGGCTGTCTGCGGACCCTGCCGCGTGC<br>AGGGGTCGCGGCCGGCTGGAGCTGGGAGTGAGGCGGCGGAGGAGCCAGGTGAGGAGG<br>AGCCAGGAAGGCAGTTGGTGGGAAGTCCAGCTTGGGTCCCTGAGAGCTGTGAGAAGG<br>AGATGCGGCTGCTGCTGGCCCTGTTGGGGGTCCTGCTGAGTGTGCCTGGGCCTCCAG<br>TCTTGTCCCTGGAGGCCTCTGAGGAAGTGGAGCTTGAGCCCTGCCTGGCTCCCAGCC<br>TGGAGCAGCAAGAGCAGGAGCTGACAGTAGCCCTTGGGCAGCCTGTGCGTCTGTGCT<br>GTGGGCGGGCTGAGCGTGGTGGCCACTGGTACAAGGAGGGCAGTCGCCTGGCACCTG<br>CTGGCCGTGTACGGGGCTGGAGGGGCCGCCTAGAGATTGCCAGCTTCCTACCTGAGG<br>ATGCTGGCCGCTACCTCTGCCTGGCACGAGGCTCCATGATCGTCCTGCAGAATCTCA<br>CCTTGATTACAGGTGACTCCTTGACCTCCAGCAACGATGATGAGGACCCCAAGTCCC<br>ATAGGGACCCCTCGAATAGGCACAGTTACCCCCAGCAAGCACCCTACTGGACACACC<br>CCCAGCGCATGGAGAAGAAACTGCATGCAGTACCTGCGGGGAACACCGTCAAGTTCC<br>GCTGTCCAGCTGCAGGCAACCCCACGCCCACCATCCGCTGGCTTAAGGATGGACAGG<br>CCTTTCATGGGGAGAACCGCATTGGAGGCATTCGGCTGCGCCATCAGCACTGGAGTC<br>TCGTGATGGAGAGCGTGGTGCCCTCGGACCGCGGCACATACACCTGCCTGGTAGAGA<br>ACGCTGTGGGCAGCATCCGCTATAACTACCTGCTAGATGTGCTGGAGCGGTCCCCGC<br>ACCGGCCCATCCTGCAGGCCGGGCTCCCGGCCAACACCACAGCCGTGGTGGGCAGCG<br>ACGTGGAGCTGCTGTGCAAGGTGTACAGCGATGCCCAGCCCCACATCCAGTGGCTGA<br>AGCACATCGTCATCAACGGCAGCAGCTTCGGAGCCGACGGTTTCCCCTATGTGCAAG<br>TCCTAAAGACTGCAGACATCAATAGCTCAGAGGTGGAGGTCCTGTACCTGCGGAACG<br>TGTCAGCCGAGGACGCAGGCGAGTACACCTGCCTCGCAGGCAATTCCATCGGCCTCT<br>CCTACCAGTCTGCCTGGCTCACGGTGCTGCCAGAGGAGGACCCCACATGGACCGCAG<br>CAGCGCCCGAGGCCAGGTATACGGACATCATCCTGTACGCGTCGGGCTCCCTGGCCT<br>TGGCTGTGCTCCTGCTGCTGGCCGGGCTGTATCGAGGGCAGGCGCTCCACGGCCGGC<br>ACCCCCGCCCGCCCGCCACTGTGCAGAAGCTCTCCCGCTTCCCTCTGGCCCGACAGT<br>TCTCCCTGGAGTCAGGCTCTTCCGGCAAGTCAAGCTCATCCCTGGTACGAGGCGTGC<br>GTCTCTCCTCCAGCGGCCCCGCCTTGCTCGCCGGCCTCGTGAGTCTAGATCTACCTC<br>TCGACCCACTATGGGAGTTCCCCCGGGACAGGCTGGTGCTTGGGAAGCCCCTAGGCG<br>AGGGCTGCTTTGGCCAGGTAGTACGTGCAGAGGCCTTTGGCATGGACCCTGCCCGGC<br>CTGACCAAGCCAGCACTGTGGCCGTCAAGATGCTCAAAGACAACGCCTCTGACAAGG<br>ACCTGGCCGACCTGGTCTCGGAGATGGAGGTGATGAAGCTGATCGGCCGACACAAGA<br>ACATCATCAACCTGCTTGGTGTCTGCACCCAGGAAGGGCCCCTGTACGTGATCGTGG<br>AGTGCGCCGCCAAGGGAAACCTGCGGGAGTTCCTGCGGGCCCGGCGCCCCCCAGGCC<br>CCGACCTCAGCCCCGACGGTCCTCGGAGCAGTGAGGGGCCGCTCTCCTTCCCAGTCC<br>TGGTCTCCTGCGCCTACCAGGTGGCCCGAGGCATGCAGTATCTGGAGTCCCGGAAGT<br>GTATCCACCGGGACCTGGCTGCCCGCAATGTGCTGGTGACTGAGGACAATGTGATGA<br>AGATTGCTGACTTTGGGCTGGCCCGCGGCGTCCACCACATTGACTACTATAAGAAAA<br>CCAGCAACGGCCGCCTGCCTGTGAAGTGGATGGCGCCCGAGGCCTTGTTTGACCGGG<br>TGTACACACACCAGAGTGACGTGTGGTCTTTTGGGATCCTGCTATGGGAGATCTTCA<br>CCCTCGGGGGCTCCCCGTATCCTGGCATCCCGGTGGAGGAGCTGTTCTCGCTGCTGC<br>GGGAGGGACATCGGATGGACCGACCCCCACACTGCCCCCCAGAGCTGTACGGGCTGA<br>TGCGTGAGTGCTGGCACGCAGCGCCCTCCCAGAGGCCTACCTTCAAGCAGCTGGTGG<br>AGGCGCTGGACAAGGTCCTGCTGGCCGTCTCTGAGGAGTACCTCGACCTCCGCCTGA<br>CCTTCGGACCCTATTCCCCCTCTGGTGGGGACGCCAGCAGCACCTGCTCCTCCAGCG<br>ATTCTGTCTTCAGCCACGACCCCCTGCCATTGGGATCCAGCTCCTTCCCCTTCGGGT<br>CTGGGGTGCAGACATGAGCAAGGCTCAAGGCTGTGCAGGCACATAGGCTGGTGGCCT<br>TGGGCCTTGGGGCTCA |
| SEQ ID NO: 54 | FGFR4 isoform 3 Amino acid sequence | MRLLLALLGVLLSVPGPPVLSLEASEEVELEPCLAPSLEQQEQELTVALGQPVRLCC<br>GRAERGGHWYKEGSRLAPAGRVRGWRGRLEIASFLPEDAGRYLCLARGSMIVLQNLT<br>LITGDSLTSSNDDEDPKSHRDPSNRHSYPQQAPYWTHPQRMEKKLHAVPAGNTVKFR<br>CPAAGNPTPTIRWLKDGQAFHGENRIGGIRLRHQHWSLVMESVVPSDRGTYTCLVEN<br>AVGSIRYNYLLDVLERSPHRPILQAGLPANTTAVVGSDVELLCKVYSDAQPHIQWLK<br>HIVINGSSFGADGFPYVQVLKTADINSSEVEVLYLRNVSAEDAGEYTCLAGNSIGLS<br>YQSAWLTVLPEEDPTWTAAAPEARYTDIILYASGSLALAVLLLLAGLYRGQALHGRH<br>PRPPATVQKLSRFPLARQFSLESGSSGKSSSSLVRGVRLSSSGPALLAGLVSLDLPL<br>DPLWEFPRDRLVLGKPLGEGCFGQVVRAEAFGMDPARPDQASTVAVKMLKDNASDKD<br>LADLVSEMEVMKLIGRHKNIINLLGVCTQEGPLYV**IVECAAKGNLR**EFLRARRPPGP<br>DLSPDGPRSSEGPLSFPVLVSCAYQVARGMQYLESRKCIHRDLAARNVLVTEDNVMK<br>IADFGLARGVHHIDYYKKTSNGRLPVKWMAPEALFDRVYTHQSDVWSFGILLWEIFT<br>LGGSPYPGIPVEELFSLLREGHRMDRPPHCPPELYGLMRECWHAAPSQRPTFKQLVE<br>ALDKVLLAVSEEYLDLRLTFGPYSPSGGDASSTCSSSDSVFSHDPLPLGSSSFPFGS<br>GVQT |
| SEQ ID NO: 55 | FGFR4 isoform 4 Nucleic acid sequence | AGTCCAGCTTGGGTCCCTGAGAGCTGTGAGAAGGAGATGCGGCTGCTGCTGGCCCTG<br>TTGGGGGTCCTGCTGAGTGTGCCTGGGCCTCCAGTCTTGTCCCTGGAGGCCTCTGAG<br>GAAGTGGAGCTTGAGCCCTGCCTGGCTCCCAGCCTGGAGCAGCAAGAGCAGGAGCTG<br>ACAGTAGCCCTTGGGCAGCCTGTGCGTCTGTGCTGTGGGCGGGCTGAGCGTGGTGGC<br>CACTGGTACAAGGAGGGCAGTCGCCTGGCACCTGCTGGCCGTGTACGGGGCTGGAGG |

TABLE 3-continued

| FGFR sequences | | |
|---|---|---|
| | | GGCCGCCTAGAGATTGCCAGCTTCCTACCTGAGGATGCTGGCCGCTACCTCTGCCTG<br>GCACGAGGCTCCATGATCGTCCTGCAGAATCTCACCTTGATTACAGGTGACTCCTTG<br>ACCTCCAGCAACGATGATGAGGACCCCAAGTCCCATAGGGACCCCTCGAATAGGCAC<br>AGTTACCCCCAGCAAGCACCCTACTGGACACACCCCCAGCGCATGGAGAAGAAACTG<br>CATGCAGTACCTGCGGGGAACACCGTCAAGTTCCGCTGTCCAGCTGCAGGCAACCCC<br>ACGCCCACCATCCGCTGGCTTAAGGATGGACAGGCCTTTCATGGGGAGAACCGCATT<br>GGAGGCATTCGGCTGCGCCATCAGCACTGGAGTCTCGTGATGGAGAGCGTGGTGCCC<br>TCGGACCGCGGCACATACACCTGCCTGGTAGAGAACGCTGTGGGCAGCATCCGCTAT<br>AACTACCTGCTAGATGTGCTGGAGCGGTCCCCGCACCGGCCCATCCTGCAGGCCGGG<br>CTCCCGGCCAACACCACAGCCGTGGTGGGCAGCGACGTGGAGCTGCTGTGCAAGGTG<br>TACAGCGATGCCCAGCCCCACATCCAGTGGCTGAAGCACATCGTCATCAACGGCAGC<br>AGCTTCGGAGCCGACGGTTTCCCCTATGTGCAAGTCCTAAAGACTGCAGACATCAAT<br>AGCTCAGAGGTGGAGGTCCTGTACCTGCGGAACGTGTCAGCCGAGGACGCAGGCGAG<br>TACACCTGCCTCGCAGGCAATTCCATCGGCCTCTCCTACCAGTCTGCCTGGCTCACG<br>GTGCTGCCAGGTACTGGGCGCATCCCCCACCTCACATGTGACAGCCTGACTCCAGCA<br>GGCAGAACCAAGTCTCCCACTTTGCAGTTCTCCCTGGAGTCAGGCTCTTCCGGCAAG<br>TCAAGCTCATCCCTGGTACGAGGCGTGCGTCTCTCCTCCAGCGGCCCCGCCTTGCTC<br>GCCGGCCTCGTGAGTCTAGATCTACCTCTCGACCCACTATGGGAGTTCCCCCGGGAC<br>AGGCTGGTGCTTGGGAAGCCCCTAGGCGAGGGCTGCTTTGGCCAGGTAGTACGTGCA<br>GAGGCCTTTGGCATGGACCCTGCCCGGCCTGACCAAGCCAGCACTGTGGCCGTCAAG<br>ATGCTCAAAGACAACGCCTCTGACAAGGACCTGGCCGACCTGGTCTCGGAGATGGAG<br>GTGATGAAGCTGATCGGCCGACACAAGAACATCATCAACCTGCTTGGTGTCTGCACC<br>CAGGAAGGGCCCCTGTACGTGATCGTGGAGTGCGCCGCCAAGGGAAACCTGCGGGAG<br>TTCCTGCGGGCCCGGCGCCCCCCAGGCCCCGACCTCAGCCCCGACGGTCCTCGGAGC<br>AGTGAGGGGCCGCTCTCCTTCCCAGTCCTGGTCTCCTGCGCCTACCAGGTGGCCCGA<br>GGCATGCAGTATCTGGAGTCCCGGAAGTGTATCCACCGGGACCTGGCTGCCCGCAAT<br>GTGCTGGTGACTGAGGACAATGTGATGAAGATTGCTGACTTTGGGCTGGCCCGCGGC<br>GTCCACCACATTGACTACTATAAGAAAACCAGCAACGGCCGCCTGCCTGTGAAGTGG<br>ATGGCGCCCGAGGCCTTGTTTGACCGGGTGTACACACACCAGAGTGACGTGTGGTCT<br>TTTGGGATCCTGCTATGGGAGATCTTCACCCTCGGGGGCTCCCCGTATCCTGGCATC<br>CCGGTGGAGGAGCTGTTCTCGCTGCTGCGGGAGGGACATCGGATGGACCGACCCCCA<br>CACTGCCCCCCAGAGCTGTACGGGCTGATGCGTGAGTGCTGGCACGCAGCGCCCTCC<br>CAGAGGCCTACCTTCAAGCAGCTGGTGGAGGCGCTGGACAAGGTCCTGCTGGCCGTC<br>TCTGAGGAGTACCTCGACCTCCGCCTGACCTTCGGACCCTATTCCCCCTCTGGTGGG<br>GACGCCAGCAGCACCTGCTCCTCCAGCGATTCTGTCTTCAGCCACGACCCCCTGCCA<br>TTGGGATCCAGCTCCTTCCCCTTCGGGTCTGGGGTGCAGACATGAGCAAGGCTCAAG<br>GCTGTGCAGGCACATAGGCTGGTGGCCTTGGGCCTTGGGGCTCAGCCACAGCCTGAC<br>ACAGTGCTCGACCTTGATAGCATG |
| SEQ ID NO: 56 | FGFR4 isoform 4 Amino acid sequence | MRLLLALLGVLLSVPGPPVLSLEASEEVELEPCLAPSLEQQEQELTVALGQPVRLCC<br>GRAERGGHWYKEGSRLAPAGRVRGWRGRLEIASFLPEDAGRYLCLARGSMIVLQNLT<br>LITGDSLTSSNDDEDPKSHRDPSNRHSYPQQAPYWTHPQRMEKKLHAVPAGNTVKFR<br>CPAAGNPTPTIRWLKDGQAFHGENRIGGIRLRHQHWSLVMESVVPSDRGTYTCLVEN<br>AVGSIRYNYLLDVLERSPHRPILQAGLPANTTAVVGSDVELLCKVYSDAQPHIQWLK<br>HIVINGSSFGADGFPYVQVLKTADINSSEVEVLYLRNVSAEDAGEYTCLAGNSIGLS<br>YQSAWLTVLPGTGRIPHLTCDSLTPAGRTKSPTLQFSLESGSSGKSSSSLVRGVRLS<br>SSGPALLAGLVSLDLPLDPLWEFPRDRLVLGKPLGEGCFGQVVRAEAFGMDPARPDQ<br>ASTVAVKMLKDNASDKDLADLVSEMEVMKLIGRHKNIINLLGVCTQEGPLYV**IVECA**<br>**AKGNLR**EFLRARRPPGPDLSPDGPRSSEGPLSFPVLVSCAYQVARGMQYLESRKCIH<br>RDLAARNVLVTEDNVMKIADFGLARGVHHIDYYKKTSNGRLPVKWMAPEALFDRVYT<br>HQSDVWSFGILLWEIFTLGGSPYPGIPVEELFSLLREGHRMDRPPHCPPELYGLMRE<br>CWHAAPSQRPTFKQLVEALDKVLLAVSEEYLDLRLTFGPYSPSGGDASSTCSSSDSV<br>FSHDPLPLGSSSFPFGSGVQT |
| SEQ ID NO: 57 | FGFR1 Subdomain V Amino acid sequence | IVEYASKGNLR |
| SEQ ID NO: 58 | FGFR2 Subdomain V Amino acid sequence | IVEYASKGNLR |
| SEQ ID NO: 59 | FGFR3 Subdomain V Amino acid sequence | LVEYAAKGNLR |
| SEQ ID NO: 60 | FGFR4 Subdomain V Amino acid sequence | IVECAAKGNLR |

Bold: FGFR subdomain V

Underlined: Cysteine in FGFR4 subdomain V

Although the invention has been described with reference to the above examples, it will be understood that modifications and variations are encompassed within the spirit and scope of the invention. Accordingly, the invention is limited only by the following claims.

SEQUENCE LISTING (60 sequences)

SEQ ID NO: 1 - protein, 5900 aa, Homo sapiens
AGATGCAGGGGCGCAAACGCCAAAGGAGACCAGGCTGTAGGAAGAGAAGGGCAGAGCGCCGGACAGCTCGGCCCGCTCCCCGTCCTTTGGGGCCGCGGCTGGGGAACTACAAGGCCCAGCAGGCAGCTGCAGGGGGCGGAGGCGGAGGAGGGACCAGCGCGGGTGGGAGTGAGAGAGCGAGCCCTCGCGCCCCGCCGGCGCATAGCGCTCGGAGCGCTCTTGCGGCCACAGGCGCGGCGTCCTCGGCGGCGGGCGGCAGCTAGCGGGAGCCGGGACGCCGGTGCAGCCGCAGCGCGCGGAGGAACCCGGGTGTGCCGGGAGCTGGGCGGCCACGTCCGGACGGGACCGAGACCCCTCGTAGCGCATTGCGGCGACCTCGCCTTCCCCGGCCGCGAGCGCGCCGCTGCTTGAAAAGCCGCGGAACCCAAGGACTTTTCTCCGGTCCGAGCTCGGGGCGCCCCGCAGGGCGCACGGTACCCGTGCTGCAGTCGGGCACGCCGCGGCGCCGGGGCCTCCGCAGGGCGATGGAGCCCGGTCTGCAAGGAAAGTGAGGCGCCGCCGCTGCGTTCTGGAGGAGGGGGGCACAAGGTCTGGAGACCCCGGGTGGCGGACGGGAGCCCTCCCCCCGCCCCGCCTCCGGGGCACCAGCTCCGGCTCCATTGTTCCCGCCCGGGCTGGAGGCGCCGAGCACCGAGCGCCGCCGGGAGTCGAGCGCCGGCCGCGGAGCTCTTGCGACCCCGCCAGGACCCGAACAGAGCCCGGGGGCGGCGGGCCGGAGCCGGGGACGCGGGCACACGCCCGCTCGCACAAGCCACGGCGGACTCTCCCGAGGCGGAACCTCCACGCCGAGCGAGGGTCAGTTTGAAAAGGAGGATCGAGCTCACTGTGGAGTATCCATGGAGATGTGGAGCCTTGTCACCAACCTCTAACTGCAGAACTGGGATGTGGAGCTGGAAGTGCCTCCTCTTCTGGGCTGTGCTGGTCACAGCCACACTCTGCACCGCTAGGCCGTCCCCGACCTTGCCTGAACAAGCCCAGCCCTGGGGAGCCCCTGTGGAAGTGGAGTCCTTCCTGGTCCACCCCGGTGACCTGCTGCAGCTTCGCTGTCGGCTGCGGGACGATGTGCAGAGCATCAACTGGCTGCGGGACGGGGTGCAGCTGGCGGAAAGCAACCGCACCCGCATCACAGGGGAGGAGGTGGAGGTGCAGGACTCCGTGCCCGCAGACTCCGGCCTCTATGCTTGCGTAACCAGCAGCCCCTCGGGCAGTGACACCACCTACTTCTCCGTCAATGTTTCAGATGCTCTCCCCTCCTCGGAGGATGATGATGATGATGATGACTCCTCTTCAGAGGAGAAAGAAACAGATAACACCAAACCAAACCGTATGCCCGTAGCTCCATATTGGACATCCCCAGAAAAGATGGAAAAGAAATTGCATGCAGTGCCGGCTGCCAAGACAGTGAAGTTCAAATGCCCTTCCAGTGGGACCCCAAACCCCACACTGCGCTGGTTGAAAAATGGCAAAGAATTCAAACCTGACCACAGAATTGGAGGCTACAAGGTCCGTTATGCCACCTGGAGCATCATAATGGACTCTGTGGTGCCCTCTGACAAGGGCAACTACACCTGCATTGTGGAGAATGAGTACGGCAGCATCAACCACACATACCAGCTGGATGTCGTGGAGCGGTCCCCTCACCGGCCCATCCTGCAAGCAGGGTTGCCCGCCAACAAAACAGTGGCCCTGGGTAGCAACGTGGAGTTCATGTGTAAGGTGTACAGTGACCCGCAGCCGCACATCCAGTGGCTAAAGCACATCGAGGTGAATGGGAGCAAGATTGGCCCAGACAACCTGCCTTATGTCCAGATCTTGAAGACTGCTGGAGTTAATACCACCGACAAAGAGATGGAGGTGCTTCACTTAAGAAATGTCTCCTTTGAGGACGCAGGGGAGTATACGTGCTTGGCGGGTAACTCTATCGGACTCTCCCATCACTCTGCATGGTTGACCGTTCTGGAAGCCCTGGAAGAGAGGCCGGCAGTGATGACCTCGCCCCTGTACCTGGAGATCATCATCTATTGCACAGGGGCCTTCCTCATCTCCTGCATGGTGGGGTCGGTCATCGTCTACAAGATGAAGAGTGGTACCAAGAAGAGTGACTTCCACAGCCAGATGGCTGTGCACAAGCTGGCCAAGAGCATCCCTCTGCGCAGACAGGTAACAGTGTCTGCTGACTCCAGTGCATCCATGAACTCTGGGGTTCTTCTGGTTCGGCCATCACGGCTCTCCTCCAGTGGGACTCCCATGCTAGCAGGGGTCTCTGAGTATGAGCTTCCCGAAGACCCTCGCTGGGAGCTGCCTCGGGACAGACTGGTCTTAGGCAAACCCCTGGGAGAGGGCTGCTTTGGGCAGGTGGTGTTGGCAGAGGCTATCGGGCTGGACAAGGACAAACCCAACCGTGTGACCAAAGTGGCTGTGAAGATGTTGAAGTCGGACGCAACAGAGAAAGACTTGTCAGACCTGATCTCAGAAATGGAGATGATGAAGATGATCGGGAAGCATAAGAATATCATCAACCTGCTGGGGGCCTGCACGCAGGATGGTCCCTTGTATGTCATCGTGGAGTATGCCTCCAAGGGCAACCTGCGGGAGTACCTGCAGGCCCGGAGGCCCCCAGGGCTGGAATACTGCTACAACCCCAGCCACAACCCAGAGGAGCAGCTCTCCTCCAAGGACCTGGTGTCCTGCGCCTACCAGGTGGCCCGAGGCATGGAGTATCTGGCCTCCAAGAAGTGCATACACCGAGACCTGGCAGCCAGGAATGTCCTGGTGACAGAGGACAATGTGATGAAGATAGCAGACTTTGGCCTCGCACGGGACATTCACCACATCGACTACTATAAAAAGACAACCAACGGCCGACTGCCTGTGAAGTGGATGGCACCCGAGGCATTATTTGACCGGATCTACACCCACCAGAGTGATGTGTGGTCTTTCGGGGTGCTCCTGTGGGAGATCTTCACTCTGGGCGGCTCCCCATACCCCGGTGTGCCTGTGGAGGAACTTTTCAAGCTGCTGAAGGAGGGTCACCGCATGGACAAGCCCAGTAACTGCACCAACGAGCTGTACATGATGATGCGGGACTGCTGGCATGCAGTGCCCTCACAGAGACCCACCTTCAAGCAGCTGGTGGAAGACCTGGACCGCATCGTGGCCTTGACCTCCAACCAGGAGTACCTGGACCTGTCCATGCCCCTGGACCAGTACTCCCCCAGCTTTCCCGACACCCGGAGCTCTACGTGCTCCTCAGGGGAGGATTCCGTCTTCTCTCATGAGCCGCTGCCCGAGGAGCCCTGCCTGCCCCGACACCCAGCCCAGCTTGCCAATGGCGGACTCAAACGCCGCTGACTGCCACCCACACGCCCTCCCCAGACTCCACCGTCAGCTGTAACCCTCACCCACAGCCCCTGCTGGGCCCACCACCTGTCCGTCCCTGTCCCCTTTCCTGCTGGCAGGAGCCGGCTGCCTACCAGGGGCCTTCCTGTGTGGCCTGCCTTCACCCCACTCAGCTCACCTCTCCCTCCACCTCCTCTCCACCTGCTGGTGAGAGGTGCAAAGAGGCAGATCTTTGCTGCCAGCCACTTCATCCCCTCCCAGATGTTGGACCAACACCCCTCCCTGCCACCAGGCACTGCCTGGAGGGCAGGGAGTGGGAGCCAATGAACAGGCATGCAAGTGAGAGCTTCCTGAGCTTTCTCCTGTCGGTTTGGTCTGTTTTGCCTTCACCCATAAGCCCCTCGCACTCTGGTGGCAGGTGCCTTGTCCTCAGGGCTACAGCAGTAGGGAGGTCAGTGCTTCGTGCCTCGATTGAAGGTGACCTCTGCCCCAGATAGGTGGTGCCAGTGGCTTATTAATTCCGATACTAGTTTGCTTTGCTGACCAAATGCCTGGTACCAGAGGATGGTGAGGCGAAGGCCAGGTTGGGGGCAGTGTTGTGGCCCTGGGGCCCAGCCCCAAACTGGGGGCTCTGTATATAGCTATGAAGAAAACACAAAGTGTATAAATCTGAGTATATATTTACATGTCTTTTTAAAAGGGTCGTTACCAGAGATTTACCCATCGGGTAAGATGCTCCTGGTGGCTGGGAGGCATCAGTTGCTATATATTAAAAACAAAAAAGAAAAAAAAGGAAAATGTTTTTAAAAAGGTCATATATTTTTTGCTACTTTTGCTGTTTTATTTTTTTAAATTATGTTCTAAACCTATTTTCAGTTTAGGTCCCTCAATAAAAATTGCTGCTGCTTCATTTATCTATGGGCTGTATGAAAAGGGTGGGAATGTCCACTGGAAAGAAGGGACACCCACGGGCCCTGGGGCTAGGTCTGTCCCGAGGGCACCGCATGCTCCCGGCGCAGGTTCCTTGTAACCTCTTCTTCCTAGGTCCTGCACCCAGACCTCACGACGCACCTCCTGCCTCTCCGCTGCTTTTGGAAAGTCAGAAAAAGAAGATGTCTGCTTCGAGGGCAGGAACCCCATCCATGCAGTAGAGGCGCTGGGCAGAGAGTCAAGGCCCAGCAGCCATCGACCATGGATGGTTTCCTCCAAGGAAACCGGTGGGGTTGGGCTGGGGAGGGGGCACCTACCTAGGAATAGCCACGGGGTAGAGCTACAGTGATTAAGAGGAAAGCAAGGGCGCGGTTGCTCACGCCTGTAATCCCAGCACTTTGGGACACCGAGGTGGGCAGATCACTTCAGGTCAGGAGTTTGAGACCAGCCTGGCCAACTTAGTGAAACCCCATCTCTACTAAAAATGCAAAAATTATCCAGGCATGGTGGCACACGCCTGTAATCCCAGCTCCACAGGAGGCTGAGGCAGAATCCCTTGAAGCTGGGAGGCGGAGGTTGCAGTGAGCCGAGATTGCGCCATTGCACTCCAGCCTGGGCAACAGAGAAAACAAAAAGGAAAACAAATGATGAAGGTCTGCAGAAACTGAAACCCAGACATGTGTCTGCCCCCTCTATGTGGGCATGGTTTTGCCAGTGCTTCTAAGTGCAGGAGAACATGTCACCTGAGGCTAGTTTTGCATTCAGGTCCCTGGCTTCGTTTCTTGTTGGTATGCCTCCCCAGATCGTCCTTCCTGTATCCATGTGACCAGACTGTATTTGTTGGGACTGTCGCAGATCTTGGCTTCTTACAGTTCTTCCTGTCCAAACTCCATCCTGTCCCTCAGGAACGGGGGGAAAATTCTCCGAATGTTTTTGGTTTTTTGGCTGCTTGGAATTTACTTCTGCCACCTGCTGGTCATCACTGTCCTCACTAAGTGGATTCTGGCTCCCCCGTACCTCATGGCTCAAACTACCACTCCTCAGTCGCTATATTAAAGCTTATATTTTGCTGGATTACTGCTAAATACAAAAGAAAGTTCAATATGTTTTCATTTCTGTAGGGAAAATGGGATTGCTGCTTTAAATTTCTGAGCTAGGGATTTTTTGGCAGCTGCAGTGTTGGCGACTATTGTAAAATTCTCTTTGTTTCTCTCTGTAAATAGCACCTGCTAACATTACAATTTGTATTTATGTTTAAAGAAGGCATCATTTGGTGAACAGAACTAGGAAATGAATTTTTAGCTCTTAAAAGCATTTGCTTTGAGACCGCACAGGAGTGTCTTTCCTTGTAAAACAGTGATGATAATTTCTGCCTTGGCCCTACCTTGAAGCAATGTTGTGTGAAGGGATGAAGAATCTAAAAGTCTTCATAAGTCCTTGGGAGAGGTGCTAGAAAAATATAAGGCACTATCATAATTACAGTGATGTCCTTGCTGTTACTACTCAAATCACCCACAAATTTCCCCAAAGACTGCGCTAGCTGTCAAATAAAAGACAGTGAAATTGACCTG

SEQ ID NO: 2 - protein, 822 aa, Homo sapiens [sequence omitted]

SEQ ID NO: 3 - protein, 5702 aa, Homo sapiens
GCCGGCGCATAGCGCTCGGAGCGCTCTTGCGGCCACAGGCGCGGCGTCCTCGGCGGCGGGCGGCAGCTAGCGGGAGCCGGGACGCCGGTGCAGCCGCAGCGCGCGGAGGAACCCGGGTGTGCCGGGAGCTGGGCGGCCACGTCCGGACGGGACCGAGACCCCTCGTAGCGCATTGCGGCGACCTCGCCTTCCCCGGCCGCGAGCGCGCCGCTGCTTGAAAAGCCGCGGAACCCAAGGACTTTTCTCCGGTCCGAGCTCGGGGCGCCCCGCAGGGCGCACGGTACCCGTGCTGCAGTCGGGCACGCCGCGGCGCCGGGGCCTCCGCAGGGCGATGGAGCCCGGTCTGCAAGGAAAGTGAGGCGCCGCCGCTGCGTTCTGGAGGAGGGGGGCACAAGGTCTGGAGACCCCGGGTGGCGGACGGGAGCCCTCCCCCCGCCCCGCCTCCGGGGCACCAGCTCCGGCTCCATTGTTCCCGCCCGGGCTGGAGGCGCCGAGCACCGAGCGCCGCCGGGAGTCGAGCGCCGGCCGCGGAGCTCTTGCGACCCCGCCAGGACCCGAACAGAGCCCGGGGGCGGCGGGCCGGAGCCGGGGACGCGGGCACACGCCCGCTCGCACAAGCCACGGCGGACTCTCCCGAGGCGGAACCTCCACGCCGAGCGAGGGTCAGTTTGAAAAGGAGGATCGAGCTCACTGTGGAGTATCCATGGAGATGTGGAGCCTTGTCACCAACCTCTAACTGCAGAACTGGGATGTGGAGCTGGAAGTGCCTCCTCTTCTGGGCTGTGCTGGTCACAGCCACACTCTGCACCGCTAGGCCGTCCCCGACCTTGCCTGAACAAGCCCAGCCCTGGGGAGCCCCTGTGGAAGTGGAGTCCTTCCTGGTCCACCCCGGTGACCTGCTGCAGCTTCGCTGTCGGCTGCGGGACGATGTGCAGAGCATCAACTGGCTGCGGGACGGGGTGCAGCTGGCGGAAAGCAACCGCACCCGCATCACAGGGGAGGAGGTGGAGGTGCAGGACTCCGTGCCCGCAGACTCCGGCCTCTATGCTTGCGTAACCAGCAGCCCCTCGGGCAGTGACACCACCTACTTCTCCGTCAATGTTTCAGATGCTCTCCCCTCCTCGGAGGATGATGATGATGATGATGACTCCTCTTCAGAGGAGAAAGAAACAGATAACACCAAACCAAACCCCGTAGCTCCATATTGGACATCCCCAGAAAAGATGGAAAAGAAATTGCATGCAGTGCCGGCTGCCAAGACAGTGAAGTTCAAATGCCCTTCCAGTGGGACCCCAAACCCCACACTGCGCTGGTTGAAAAATGGCAAAGAATTCAAACCTGACCACAGAATTGGAGGCTACAAGGTCCGTTATGCCACCTGGAGCATCATAATGGACTCTGTGGTGCCCTCTGACAAGGGCAACTACACCTGCATTGTGGAGAATGAGTACGGCAGCATCAACCACACATACCAGCTGGATGTCGTGGAGCGGTCCCCTCACCGGCCCATCCTGCAAGCAGGGTTGCCCGCCAACAAAACAGTGGCCCTGGGTAGCAACGTGGAGTTCATGTGTAAGGTGTACAGTGACCCGCAGCCGCACATCCAGTGGCTAAAGCACATCGAGGTGAATGGGAGCAAGATTGGCCCAGACAACCTGCCTTATGTCCAGATCTTGAAGACTGCTGGAGTTAATACCACCGACAAAGAGATGGAGGTGCTTCACTTAAGAAATGTCTCCTTTGAGGACGCAGGGGAGTATACGTGCTTGGCGGGTAACTCTATCGGACTCTCCCATCACTCTGCATGGTTGACCGTTCTGGAAGCCCTGGAAGAGAGGCCGGCAGTGATGACCTCGCCCCTGTACCTGGAGATCATCATCTATTGCACAGGGGCCTTCCTCATCTCCTGCATGGTGGGGTCGGTCATCGTCTACAAGATGAAGAGTGGTACCAAGAAGAGTGACTTCCACAGCCAGATGGCTGTGCACAAGCTGGCCAAGAGCATCCCTCTGCGCAGACAGGTAACAGTGTCTGCTGACTCCAGTGCATCCATGAACTCTGGGGTTCTTCTGGTTCGGCCATCACGGCTCTCCTCCAGTGGGACTCCCATGCTAGCAGGGGTCTCTGAGTATGAGCTTCCCGAAGACCCTCGCTGGGAGCTGCCTCGGGACAGACTGGTCTTAGGCAAACCCCTGGGAGAGGGCTGCTTTGGGCAGGTGGTGTTGGCAGAGGCTATCGGGCTGGACAAGGACAAACCCAACCGTGTGACCAAAGTGGCTGTGAAGATGTTGAAGTCGGACGCAACAGAGAAAGACTTGTCAGACCTGATCTCAGAAATGGAGATGATGAAGATGATCGGGAAGCATAAGAATATCATCAACCTGCTGGGGGCCTGCACGCAGGATGGTCCCTTGTATGTCATCGTGGAGTATGCCTCCAAGGGCAACCTGCGGGAGTACCTGCAGGCCCGGAGGCCCCCAGGGCTGGAATACTGCTACAACCCCAGCCACAACCCAGAGGAGCAGCTCTCCTCCAAGGACCTGGTGTCCTGCGCCTACCAGGTGGCCCGAGGCATGGAGTATCTGGCCTCCAAGAAGTGCATACACCGAGACCTGGCAGCCAGGAATGTCCTGGTGACAGAGGACAATGTGATGAAGATAGCAGACTTTGGCCTCGCACGGGACATTCACCACATCGACTACTATAAAAAGACAACCAACGGCCGACTGCCTGTGAAGTGGATGGCACCCGAGGCATTATTTGACCGGATCTACACCCACCAGAGTGATGTGTGGTCTTTCGGGGTGCTCCTGTGGGAGATCTTCACTCTGGGCGGCTCCCCATACCCCGGTGTGCCTGTGGAGGAACTTTTCAAGCTGCTGAAGGAGGGTCACCGCATGGACAAGCCCAGTAACTGCACCAACGAGCTGTACATGATGATGCGGGACTGCTGGCATGCAGTGCCCTCACAGAGACCCACCTTCAAGCAGCTGGTGGAAGACCTGGACCGCATCGTGGCCTTGACCTCCAACCAGGAGTACCTGGACCTGTCCATGCCCCTGGACCAGTACTCCCCCAGCTTTCCCGACACCCGGAGCTCTACGTGCTCCTCAGGGGAGGATTCCGTCTTCTCTCATGAGCCGCTGCCCGAGGAGCCCTGCCTGCCCCGACACCCAGCCCAGCTTGCCAATGGCGGACTCAAACGCCGCTGACTGCCACCCACACGCCCTCCCCAGACTCCACCGTCAGCTGTAACCCTCACCCACAGCCCCTGCTGGGCCCACCACCTGTCCGTCCCTGTCCCCTTTCCTGCTGGCAGGAGCCGGCTGCCTACCAGGGGCCTTCCTGTGTGGCCTGCCTTCACCCCACTCAGCTCACCTCTCCCTCCACCTCCTCTCCACCTGCTGGTGAGAGGTGCAAAGAGGCAGATCTTTGCTGCCAGCCACTTCATCCCCTCCCAGATGTTGGACCAACACCCCTCCCTGCCACCAGGCACTGCCTGGAGGGCAGGGAGTGGGAGCCAATGAACAGGCATGCAAGTGAGAGCTTCCTGAGCTTTCTCCTGTCGGTTTGGTCTGTTTTGCCTTCACCCATAAGCCCCTCGCACTCTGGTGGCAGGTGCCTTGTCCTCAGGGCTACAGCAGTAGGGAGGTCAGTGCTTCGTGCCTCGATTGAAGGTGACCTCTGCCCCAGATAGGTGGTGCCAGTGGCTTATTAATTCCGATACTAGTTTGCTTTGCTGACCAAATGCCTGGTACCAGAGGATGGTGAGGCGAAGGCCAGGTTGGGGGCAGTGTTGTGGCCCTGGGGCCCAGCCCCAAACTGGGGGCTCTGTATATAGCTATGAAGAAAACACAAAGTGTATAAATCTGAGTATATATTTACATGTCTTTTTAAAAGGGTCGTTACCAGAGATTTACCCATCGGGTAAGATGCTCCTGGTGGCTGGGAGGCATCAGTTGCTATATATTAAAAACAAAAAAGAAAAAAAAGGAAAATGTTTTTAAAAAGGTCATATATTTTTTGCTACTTTTGCTGTTTTATTTTTTTAAATTATGTTCTAAACCTATTTTCAGTTTAGGTCCCTCAATAAAAATTGCTGCTGCTTCATTTATCTATGGGCTGTATGAAAAGGGTGGGAATGTCCACTGGAAAGAAGGGACACCCACGGGCCCTGGGGCTAGGTCTGTCCCGAGGGCACCGCATGCTCCCGGCGCAGGTTCCTTGTAACCTCTTCTTCCTAGGTCCTGCACCCAGACCTCACGACGCACCTCCTGCCTCTCCGCTGCTTTTGGAAAGTCAGAAAAAGAAGATGTCTGCTTCGAGGGCAGGAACCCCATCCATGCAGTAGAGGCGCTGGGCAGAGAGTCAAGGCCCAGCAGCCATCGACCATGGATGGTTTCCTCCAAGGAAACCGGTGGGGTTGGGCTGGGGAGGGGGCACCTACCTAGGAATAGCCACGGGGTAGAGCTACAGTGATTAAGAGGAAAGCAAGGGCGCGGTTGCTCACGCCTGTAATCCCAGCACTTTGGGACACCGAGGTGGGCAGATCACTTCAGGTCAGGAGTTTGAGACCAGCCTGGCCAACTTAGTGAAACCCCATCTCTACTAAAAATGCAAAAATTATCCAGGCATGGTGGCACACGCCTGTAATCCCAGCTCCACAGGAGGCTGAGGCAGAATCCCTTGAAGCTGGGAGGCGGAGGTTGCAGTGAGCCGAGATTGCGCCATTGCACTCCAGCCTGGGCAACAGAGAAAACAAAAAGGAAAACAAATGATGAAGGTCTGCAGAAACTGAAACCCAGACATGTGTCTGCCCCCTCTATGTGGGCATGGTTTTGCCAGTGCTTCTAAGTGCAGGAGAACATGTCACCTGAGGCTAGTTTTGCATTCAGGTCCCTGGCTTCGTTTCTTGTTGGTATGCCTCCCCAGATCGTCCTTCCTGTATCCATGTGACCAGACTGTATTTGTTGGGACTGTCGCAGATCTTGGCTTCTTACAGTTCTTCCTGTCCAAACTCCATCCTGTCCCTCAGGAACGGGGGGAAAATTCTCCGAATGTTTTTGGTTTTTTGGCTGCTTGGAATTTACTTCTGCCACCTGCTGGTCATCACTGTCCTCACTAAGTGGATTCTGGCTCCCCCGTACCTCATGGCTCAAACTACCACTCCTCAGTCGCTATATTAAAGCTTATATTTTGCTGGATTACTGCTAAATACAAAAGAAAGTTCAATATGTTTTCATTTCTGTAGGGAAAATGGGATTGCTGCTTTAAATTTCTGAGCTAGGGATTTTTTGGCAGCTGCAGTGTTGGCGACTATTGTAAAATTCTCTTTGTTTCTCTCTGTAAATAGCACCTGCTAACATTACAATTTGTATTTATGTTTAAAGAAGGCATCATTTGGTGAACAGAACTAGGAAATGAATTTTTAGCTCTTAAAAGCATTTGCTTTGAGACCGCACAGGAGTGTCTTTCCTTGTAAAACAGTGATGATAATTTCTGCCTTGGCCCTACCTTGAAGCAATGTTGTGTGAAGGGATGAAGAATCTAAAAGTCTTCATAAGTCCTTGGGAGAGGTGCTAGAAAAATATAAGGCACTATCATAATTACAGTGATGTCCTTGCTGTTACTACTCAAATCACCCACAAATTTCCCCAAAGACTGCGCTAGCTGTCAAATAAAAGACAGTGAAATTGACCTGA

SEQ ID NO: 4 - protein, 820 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 5 - protein, 5590 aa, Homo sapiens
AGCGCTCTTGCGGCCACAGGCGCGGCGTCCTCGGCGGCGGGCGGCAGCTAGCGGGAGCCGGGACGCCGGTGCAGCCGCAGCGCGCGGAGGAACCCGGGTGTGCCGGGAGCTGGGCGGCCACGTCCGGACGGGACCGAGACCCCTCGTAGCGCATTGCGGCGACCTCGCCTTCCCCGGCCGCGAGCGCGCCGCTGCTTGAAAAGCCGCGGAACCCAAGGACTTTTCTCCGGTCCGAGCTCGGGGCGCCCCGCAGGGCGCACGGTACCCGTGCTGCAGTCGGGCACGCCGCGGCGCCGGGGCCTCCGCAGGGCGATGGAGCCCGGTCTGCAAGGAAAGTGAGGCGCCGCCGCTGCGTTCTGGAGGAGGGGGGCACAAGGTCTGGAGACCCCGGGTGGCGGACGGGAGCCCTCCCCCCGCCCCGCCTCCGGGGCACCAGCTCCGGCTCCATTGTTCCCGCCCGGGCTGGAGGCGCCGAGCACCGAGCGCCGCCGGGAGTCGAGCGCCGGCCGCGGAGCTCTTGCGACCCCGCCAGGACCCGAACAGAGCCCGGGGGCGGCGGGCCGGAGCCGGGGACGCGGGCACACGCCCGCTCGCACAAGCCACGGCGGACTCTCCCGAGGCGGAACCTCCACGCCGAGCGAGGGTCAGTTTGAAAAGGAGGATCGAGCTCACTGTGGAGTATCCATGGAGATGTGGAGCCTTGTCACCAACCTCTAACTGCAGAACTGGGATGTGGAGCTGGAAGTGCCTCCTCTTCTGGGCTGTGCTGGTCACAGCCACACTCTGCACCGCTAGGCCGTCCCCGACCTTGCCTGAACAAGCCCAGCCCTGGGGAGCCCCTGTGGAAGTGGAGTCCTTCCTGGTCCACCCCGGTGACCTGCTGCAGCTTCGCTGTCGGCTGCGGGACGATGTGCAGAGCATCAACTGGCTGCGGGACGGGGTGCAGCTGGCGGAAAGCAACCGCACCCGCATCACAGGGGAGGAGGTGGAGGTGCAGGACTCCGTGCCCGCAGACTCCGGCCTCTATGCTTGCGTAACCAGCAGCCCCTCGGGCAGTGACACCACCTACTTCTCCGTCAATGTTTCAGATGCTCTCCCCTCCTCGGAGGATGATGATGATGATGATGACTCCTCTTCAGAGGAGAAAGAAACAGATAACACCAAACCAAACCGTATGCCCGTAGCTCCATATTGGACATCCCCAGAAAAGATGGAAAAGAAATTGCATGCAGTGCCGGCTGCCAAGACAGTGAAGTTCAAATGCCCTTCCAGTGGGACCCCAAACCCCACACTGCGCTGGTTGAAAAATGGCAAAGAATTCAAACCTGACCACAGAATTGGAGGCTACAAGGTCCGTTATGCCACCTGGAGCATCATAATGGACTCTGTGGTGCCCTCTGACAAGGGCAACTACACCTGCATTGTGGAGAATGAGTACGGCAGCATCAACCACACATACCAGCTGGATGTCGTGGAGCGGTCCCCTCACCGGCCCATCCTGCAAGCAGGGTTGCCCGCCAACAAAACAGTGGCCCTGGGTAGCAACGTGGAGTTCATGTGTAAGGTGTACAGTGACCCGCAGCCGCACATCCAGTGGCTAAAGCACATCGAGGTGAATGGGAGCAAGATTGGCCCAGACAACCTGCCTTATGTCCAGATCTTGAAGACTGCTGGAGTTAATACCACCGACAAAGAGATGGAGGTGCTTCACTTAAGAAATGTCTCCTTTGAGGACGCAGGGGAGTATACGTGCTTGGCGGGTAACTCTATCGGACTCTCCCATCACTCTGCATGGTTGACCGTTCTGGAAGCCCTGGAAGAGAGGCCGGCAGTGATGACCTCGCCCCTGTACCTGGAGATCATCATCTATTGCACAGGGGCCTTCCTCATCTCCTGCATGGTGGGGTCGGTCATCGTCTACAAGATGAAGAGTGGTACCAAGAAGAGTGACTTCCACAGCCAGATGGCTGTGCACAAGCTGGCCAAGAGCATCCCTCTGCGCAGACAGGTGTCTGCTGACTCCAGTGCATCCATGAACTCTGGGGTTCTTCTGGTTCGGCCATCACGGCTCTCCTCCAGTGGGACTCCCATGCTAGCAGGGGTCTCTGAGTATGAGCTTCCCGAAGACCCTCGCTGGGAGCTGCCTCGGGACAGACTGGTCTTAGGCAAACCCCTGGGAGAGGGCTGCTTTGGGCAGGTGGTGTTGGCAGAGGCTATCGGGCTGGACAAGGACAAACCCAACCGTGTGACCAAAGTGGCTGTGAAGATGTTGAAGTCGGACGCAACAGAGAAAGACTTGTCAGACCTGATCTCAGAAATGGAGATGATGAAGATGATCGGGAAGCATAAGAATATCATCAACCTGCTGGGGGCCTGCACGCAGGATGGTCCCTTGTATGTCATCGTGGAGTATGCCTCCAAGGGCAACCTGCGGGAGTACCTGCAGGCCCGGAGGCCCCCAGGGCTGGAATACTGCTACAACCCCAGCCACAACCCAGAGGAGCAGCTCTCCTCCAAGGACCTGGTGTCCTGCGCCTACCAGGTGGCCCGAGGCATGGAGTATCTGGCCTCCAAGAAGTGCATACACCGAGACCTGGCAGCCAGGAATGTCCTGGTGACAGAGGACAATGTGATGAAGATAGCAGACTTTGGCCTCGCACGGGACATTCACCACATCGACTACTATAAAAAGACAACCAACGGCCGACTGCCTGTGAAGTGGATGGCACCCGAGGCATTATTTGACCGGATCTACACCCACCAGAGTGATGTGTGGTCTTTCGGGGTGCTCCTGTGGGAGATCTTCACTCTGGGCGGCTCCCCATACCCCGGTGTGCCTGTGGAGGAACTTTTCAAGCTGCTGAAGGAGGGTCACCGCATGGACAAGCCCAGTAACTGCACCAACGAGCTGTACATGATGATGCGGGACTGCTGGCATGCAGTGCCCTCACAGAGACCCACCTTCAAGCAGCTGGTGGAAGACCTGGACCGCATCGTGGCCTTGACCTCCAACCAGGAGTACCTGGACCTGTCCATGCCCCTGGACCAGTACTCCCCCAGCTTTCCCGACACCCGGAGCTCTACGTGCTCCTCAGGGGAGGATTCCGTCTTCTCTCATGAGCCGCTGCCCGAGGAGCCCTGCCTGCCCCGACACCCAGCCCAGCTTGCCAATGGCGGACTCAAACGCCGCTGACTGCCACCCACACGCCCTCCCCAGACTCCACCGTCAGCTGTAACCCTCACCCACAGCCCCTGCTGGGCCCACCACCTGTCCGTCCCTGTCCCCTTTCCTGCTGGCAGGAGCCGGCTGCCTACCAGGGGCCTTCCTGTGTGGCCTGCCTTCACCCCACTCAGCTCACCTCTCCCTCCACCTCCTCTCCACCTGCTGGTGAGAGGTGCAAAGAGGCAGATCTTTGCTGCCAGCCACTTCATCCCCTCCCAGATGTTGGACCAACACCCCTCCCTGCCACCAGGCACTGCCTGGAGGGCAGGGAGTGGGAGCCAATGAACAGGCATGCAAGTGAGAGCTTCCTGAGCTTTCTCCTGTCGGTTTGGTCTGTTTTGCCTTCACCCATAAGCCCCTCGCACTCTGGTGGCAGGTGCCTTGTCCTCAGGGCTACAGCAGTAGGGAGGTCAGTGCTTCGTGCCTCGATTGAAGGTGACCTCTGCCCCAGATAGGTGGTGCCAGTGGCTTATTAATTCCGATACTAGTTTGCTTTGCTGACCAAATGCCTGGTACCAGAGGATGGTGAGGCGAAGGCCAGGTTGGGGGCAGTGTTGTGGCCCTGGGGCCCAGCCCCAAACTGGGGGCTCTGTATATAGCTATGAAGAAAACACAAAGTGTATAAATCTGAGTATATATTTACATGTCTTTTTAAAAGGGTCGTTACCAGAGATTTACCCATCGGGTAAGATGCTCCTGGTGGCTGGGAGGCATCAGTTGCTATATATTAAAAACAAAAAAGAAAAAAAAGGAAAATGTTTTTAAAAAGGTCATATATTTTTTGCTACTTTTGCTGTTTTATTTTTTTAAATTATGTTCTAAACCTATTTTCAGTTTAGGTCCCTCAATAAAAATTGCTGCTGCTTCATTTATCTATGGGCTGTATGAAAAGGGTGGGAATGTCCACTGGAAAGAAGGGACACCCACGGGCCCTGGGGCTAGGTCTGTCCCGAGGGCACCGCATGCTCCCGGCGCAGGTTCCTTGTAACCTCTTCTTCCTAGGTCCTGCACCCAGACCTCACGACGCACCTCCTGCCTCTCCGCTGCTTTTGGAAAGTCAGAAAAAGAAGATGTCTGCTTCGAGGGCAGGAACCCCATCCATGCAGTAGAGGCGCTGGGCAGAGAGTCAAGGCCCAGCAGCCATCGACCATGGATGGTTTCCTCCAAGGAAACCGGTGGGGTTGGGCTGGGGAGGGGGCACCTACCTAGGAATAGCCACGGGGTAGAGCTACAGTGATTAAGAGGAAAGCAAGGGCGCGGTTGCTCACGCCTGTAATCCCAGCACTTTGGGACACCGAGGTGGGCAGATCACTTCAGGTCAGGAGTTTGAGACCAGCCTGGCCAACTTAGTGAAACCCCATCTCTACTAAAAATGCAAAAATTATCCAGGCATGGTGGCACACGCCTGTAATCCCAGCTCCACAGGAGGCTGAGGCAGAATCCCTTGAAGCTGGGAGGCGGAGGTTGCAGTGAGCCGAGATTGCGCCATTGCACTCCAGCCTGGGCAACAGAGAAAACAAAAAGGAAAACAAATGATGAAGGTCTGCAGAAACTGAAACCCAGACATGTGTCTGCCCCCTCTATGTGGGCATGGTTTTGCCAGTGCTTCTAAGTGCAGGAGAACATGTCACCTGAGGCTAGTTTTGCATTCAGGTCCCTGGCTTCGTTTCTTGTTGGTATGCCTCCCCAGATCGTCCTTCCTGTATCCATGTGACCAGACTGTATTTGTTGGGACTGTCGCAGATCTTGGCTTCTTACAGTTCTTCCTGTCCAAACTCCATCCTGTCCCTCAGGAACGGGGGGAAAATTCTCCGAATGTTTTTGGTTTTTTGGCTGCTTGGAATTTACTTCTGCCACCTGCTGGTCATCACTGTCCTCACTAAGTGGATTCTGGCTCCCCCGTACCTCATGGCTCAAACTACCACTCCTCAGTCGCTATATTAAAGCTTATATTTTGCTGGATTACTGCTAAATACAAAAGAAAGTTCAATATGTTTTCATTTCTGTAGGGAAAATGGGATTGCTGCTTTAAATTTCTGAGCTAGGGATTTTTTGGCAGCTGCAGTGTTGGCGACTATTGTAAAATTCTCTTTGTTTCTCTCTGTAAATAGCACCTGCTAACATTACAATTTGTATTTATGTTTAAAGAAGGCATCATTTGGTGAACAGAACTAGGAAATGAATTTTTAGCTCTTAAAAGCATTTGCTTTGAGACCGCACAGGAGTGTCTTTCCTTGTAAAACAGTGATGATAATTTCTGCCTTGGCCCTACCTTGAAGCAATGTTGTGTGAAGGGATGAAGAATCTAAAAGTCTTCATAAGTCCTTGGGAGAGGTGCTAGAAAAATATAAGGCACTATCATAATTA

SEQ ID NO: 6 - protein, 820 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 7 - protein, 5375 aa, Homo sapiens
CCCTTTCACCTCCTGGCTCCCTCCCGGGCGATCCGCGCCCCTTGGGTCTCCCCTCCCTTCCCTCCGTCCGCGTCTCCTGCGCCCCCTCCCTGCGCTCGTCCCGCCGCTCTTCCCGCCGCCCAACTTTTCCTCCAACTCGCGCTCGGGAGCTGGCGAGGCGGCGGCGGCTCCTCAAAGTGGGAGAGCTTCAAGGTCACGTGGTCCGTCCAGCCCCTGCTATCTCACCAGACACTGTCCACCCTGTATGTTGGATCAGTACTCCAGTGAGAAGACAGCAGGCACTTTCACCCATGCAGCCCATTCAGTCTTCATAACCACCTGTGATGGAGGCAAGGGTCAGTTTGAAAAGGAGGATCGAGCTCACTGTGGAGTATCCATGGAGATGTGGAGCCTTGTCACCAACCTCTAACTGCAGAACTGGGATGTGGAGCTGGAAGTGCCTCCTCTTCTGGGCTGTGCTGGTCACAGCCACACTCTGCACCGCTAGGCCGTCCCCGACCTTGCCTGAACAAGCCCAGCCCTGGGGAGCCCCTGTGGAAGTGGAGTCCTTCCTGGTCCACCCCGGTGACCTGCTGCAGCTTCGCTGTCGGCTGCGGGACGATGTGCAGAGCATCAACTGGCTGCGGGACGGGGTGCAGCTGGCGGAAAGCAACCGCACCCGCATCACAGGGGAGGAGGTGGAGGTGCAGGACTCCGTGCCCGCAGACTCCGGCCTCTATGCTTGCGTAACCAGCAGCCCCTCGGGCAGTGACACCACCTACTTCTCCGTCAATGTTTCAGATGCTCTCCCCTCCTCGGAGGATGATGATGATGATGATGACTCCTCTTCAGAGGAGAAAGAAACAGATAACACCAAACCAAACCCCGTAGCTCCATATTGGACATCCCCAGAAAAGATGGAAAAGAAATTGCATGCAGTGCCGGCTGCCAAGACAGTGAAGTTCAAATGCCCTTCCAGTGGGACCCCAAACCCCACACTGCGCTGGTTGAAAAATGGCAAAGAATTCAAACCTGACCACAGAATTGGAGGCTACAAGGTCCGTTATGCCACCTGGAGCATCATAATGGACTCTGTGGTGCCCTCTGACAAGGGCAACTACACCTGCATTGTGGAGAATGAGTACGGCAGCATCAACCACACATACCAGCTGGATGTCGTGGAGCGGTCCCCTCACCGGCCCATCCTGCAAGCAGGGTTGCCCGCCAACAAAACAGTGGCCCTGGGTAGCAACGTGGAGTTCATGTGTAAGGTGTACAGTGACCCGCAGCCGCACATCCAGTGGCTAAAGCACATCGAGGTGAATGGGAGCAAGATTGGCCCAGACAACCTGCCTTATGTCCAGATCTTGAAGACTGCTGGAGTTAATACCACCGACAAAGAGATGGAGGTGCTTCACTTAAGAAATGTCTCCTTTGAGGACGCAGGGGAGTATACGTGCTTGGCGGGTAACTCTATCGGACTCTCCCATCACTCTGCATGGTTGACCGTTCTGGAAGCCCTGGAAGAGAGGCCGGCAGTGATGACCTCGCCCCTGTACCTGGAGATCATCATCTATTGCACAGGGGCCTTCCTCATCTCCTGCATGGTGGGGTCGGTCATCGTCTACAAGATGAAGAGTGGTACCAAGAAGAGTGACTTCCACAGCCAGATGGCTGTGCACAAGCTGGCCAAGAGCATCCCTCTGCGCAGACAGGTAACAGTGTCTGCTGACTCCAGTGCATCCATGAACTCTGGGGTTCTTCTGGTTCGGCCATCACGGCTCTCCTCCAGTGGGACTCCCATGCTAGCAGGGGTCTCTGAGTATGAGCTTCCCGAAGACCCTCGCTGGGAGCTGCCTCGGGACAGACTGGTCTTAGGCAAACCCCTGGGAGAGGGCTGCTTTGGGCAGGTGGTGTTGGCAGAGGCTATCGGGCTGGACAAGGACAAACCCAACCGTGTGACCAAAGTGGCTGTGAAGATGTTGAAGTCGGACGCAACAGAGAAAGACTTGTCAGACCTGATCTCAGAAATGGAGATGATGAAGATGATCGGGAAGCATAAGAATATCATCAACCTGCTGGGGGCCTGCACGCAGGATGGTCCCTTGTATGTCATCGTGGAGTATGCCTCCAAGGGCAACCTGCGGGAGTACCTGCAGGCCCGGAGGCCCCCAGGGCTGGAATACTGCTACAACCCCAGCCACAACCCAGAGGAGCAGCTCTCCTCCAAGGACCTGGTGTCCTGCGCCTACCAGGTGGCCCGAGGCATGGAGTATCTGGCCTCCAAGAAGTGCATACACCGAGACCTGGCAGCCAGGAATGTCCTGGTGACAGAGGACAATGTGATGAAGATAGCAGACTTTGGCCTCGCACGGGACATTCACCACATCGACTACTATAAAAAGACAACCAACGGCCGACTGCCTGTGAAGTGGATGGCACCCGAGGCATTATTTGACCGGATCTACACCCACCAGAGTGATGTGTGGTCTTTCGGGGTGCTCCTGTGGGAGATCTTCACTCTGGGCGGCTCCCCATACCCCGGTGTGCCTGTGGAGGAACTTTTCAAGCTGCTGAAGGAGGGTCACCGCATGGACAAGCCCAGTAACTGCACCAACGAGCTGTACATGATGATGCGGGACTGCTGGCATGCAGTGCCCTCACAGAGACCCACCTTCAAGCAGCTGGTGGAAGACCTGGACCGCATCGTGGCCTTGACCTCCAACCAGGAGTACCTGGACCTGTCCATGCCCCTGGACCAGTACTCCCCCAGCTTTCCCGACACCCGGAGCTCTACGTGCTCCTCAGGGGAGGATTCCGTCTTCTCTCATGAGCCGCTGCCCGAGGAGCCCTGCCTGCCCCGACACCCAGCCCAGCTTGCCAATGGCGGACTCAAACGCCGCTGACTGCCACCCACACGCCCTCCCCAGACTCCACCGTCAGCTGTAACCCTCACCCACAGCCCCTGCTGGGCCCACCACCTGTCCGTCCCTGTCCCCTTTCCTGCTGGCAGGAGCCGGCTGCCTACCAGGGGCCTTCCTGTGTGGCCTGCCTTCACCCCACTCAGCTCACCTCTCCCTCCACCTCCTCTCCACCTGCTGGTGAGAGGTGCAAAGAGGCAGATCTTTGCTGCCAGCCACTTCATCCCCTCCCAGATGTTGGACCAACACCCCTCCCTGCCACCAGGCACTGCCTGGAGGGCAGGGAGTGGGAGCCAATGAACAGGCATGCAAGTGAGAGCTTCCTGAGCTTTCTCCTGTCGGTTTGGTCTGTTTTGCCTTCACCCATAAGCCCCTCGCACTCTGGTGGCAGGTGCCTTGTCCTCAGGGCTACAGCAGTAGGGAGGTCAGTGCTTCGTGCCTCGATTGAAGGTGACCTCTGCCCCAGATAGGTGGTGCCAGTGGCTTATTAATTCCGATACTAGTTTGCTTTGCTGACCAAATGCCTGGTACCAGAGGATGGTGAGGCGAAGGCCAGGTTGGGGGCAGTGTTGTGGCCCTGGGGCCCAGCCCCAAACTGGGGGCTCTGTATATAGCTATGAAGAAAACACAAAGTGTATAAATCTGAGTATATATTTACATGTCTTTTTAAAAGGGTCGTTACCAGAGATTTACCCATCGGGTAAGATGCTCCTGGTGGCTGGGAGGCATCAGTTGCTATATATTAAAAACAAAAAAGAAAAAAAAGGAAAATGTTTTTAAAAAGGTCATATATTTTTTGCTACTTTTGCTGTTTTATTTTTTTAAATTATGTTCTAAACCTATTTTCAGTTTAGGTCCCTCAATAAAAATTGCTGCTGCTTCATTTATCTATGGGCTGTATGAAAAGGGTGGGAATGTCCACTGGAAAGAAGGGACACCCACGGGCCCTGGGGCTAGGTCTGTCCCGAGGGCACCGCATGCTCCCGGCGCAGGTTCCTTGTAACCTCTTCTTCCTAGGTCCTGCACCCAGACCTCACGACGCACCTCCTGCCTCTCCGCTGCTTTTGGAAAGTCAGAAAAAGAAGATGTCTGCTTCGAGGGCAGGAACCCCATCCATGCAGTAGAGGCGCTGGGCAGAGAGTCAAGGCCCAGCAGCCATCGACCATGGATGGTTTCCTCCAAGGAAACCGGTGGGGTTGGGCTGGGGAGGGGGCACCTACCTAGGAATAGCCACGGGGTAGAGCTACAGTGATTAAGAGGAAAGCAAGGGCGCGGTTGCTCACGCCTGTAATCCCAGCACTTTGGGACACCGAGGTGGGCAGATCACTTCAGGTCAGGAGTTTGAGACCAGCCTGGCCAACTTAGTGAAACCCCATCTCTACTAAAAATGCAAAAATTATCCAGGCATGGTGGCACACGCCTGTAATCCCAGCTCCACAGGAGGCTGAGGCAGAATCCCTTGAAGCTGGGAGGCGGAGGTTGCAGTGAGCCGAGATTGCGCCATTGCACTCCAGCCTGGGCAACAGAGAAAACAAAAAGGAAAACAAATGATGAAGGTCTGCAGAAACTGAAACCCAGACATGTGTCTGCCCCCTCTATGTGGGCATGGTTTTGCCAGTGCTTCTAAGTGCAGGAGAACATGTCACCTGAGGCTAGTTTTGCATTCAGGTCCCTGGCTTCGTTTCTTGTTGGTATGCCTCCCCAGATCGTCCTTCCTGTATCCATGTGACCAGACTGTATTTGTTGGGACTGTCGCAGATCTTGGCTTCTTACAGTTCTTCCTGTCCAAACTCCATCCTGTCCCTCAGGAACGGGGGGAAAATTCTCCGAATGTTTTTGGTTTTTTGGCTGCTTGGAATTTACTTCTGCCACCTGCTGGTCATCACTGTCCTCACTAAGTGGATTCTGGCTCCCCCGTACCTCATGGCTCAAACTACCACTCCTCAGTCGCTATATTAAAGCTTATATTTTGCTGGATTACTGCTAAATACAAAAGAAAGTTCAATATGTTTTCATTTCTGTAGGGAAAATGGGATTGCTGCTTTAAATTTCTGAGCTAGGGATTTTTTGGCAGCTGCAGTGTTGGCGACTATTGTAAAATTCTCTTTGTTTCTCTCTGTAAATAGCACCTGCTAACATTACAATTTGTATTTATGTTTAAAGAAGGCATCATTTGGTGAACAGAACTAGGAAATGAATTTTTAGCTCTTAAAAGCATTTGCTTTGAGACCGCACAGGAGTGTCTTTCCTTGTAAAACAGTGATGATAATTTCTGCCTTGGCCCTACCTTGAAGCAATGTTGTGTGAAGGGATGAAGAATCTAAAAGTCTTCATAAGTCCTTGGGAGAGGTGCTAGAAAAATATAAGGCACTATCATAATTACAGTGATGTCCTTGCTGTTACTACTCAAATCACCCACAAATTTCCCCAAAGACTGCGCTAGCTGTCAAATAAAAGACAGTGAAATTGACCTGA

SEQ ID NO: 8 - protein, 853 aa, Homo sapiens
MEARVSLKRRIELTVEYPWRCGALSPTSNCRTGMWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 9 - protein, 4157 aa, Homo sapiens
GCGCTCTTGCGGCCACAGGCGCGGCGTCCTCGGCGGCGGGCGGCAGCTAGCGGGAGCCGGGACGCCGGTGCAGCCGCAGCGCGCGGAGGAACCCGGGTGTGCCGGGAGCTGGGCGGCCACGTCCGGACGGGACCGAGACCCCTCGTAGCGCATTGCGGCGACCTCGCCTTCCCCGGCCGCGAGCGCGCCGCTGCTTGAAAAGCCGCGGAACCCAAGGACTTTTCTCCGGTCCGAGCTCGGGGCGCCCCGCAGGGCGCACGGTACCCGTGCTGCAGTCGGGCACGCCGCGGCGCCGGGGCCTCCGCAGGGCGATGGAGCCCGGTCTGCAAGGAAAGTGAGGCGCCGCCGCTGCGTTCTGGAGGAGGGGGGCACAAGGTCTGGAGACCCCGGGTGGCGGACGGGAGCCCTCCCCCCGCCCCGCCTCCGGGGCACCAGCTCCGGCTCCATTGTTCCCGCCCGGGCTGGAGGCGCCGAGCACCGAGCGCCGCCGGGAGTCGAGCGCCGGCCGCGGAGCTCTTGCGACCCCGCCAGGACCCGAACAGAGCCCGGGGGCGGCGGGCCGGAGCCGGGGACGCGGGCACACGCCCGCTCGCACAAGCCACGGCGGACTCTCCCGAGGCGGAACCTCCACGCCGAGCGAGGGTCAGTTTGAAAAGGAGGATCGAGCTCACTGTGGAGTATCCATGGAGATGTGGAGCCTTGTCACCAACCTCTAACTGCAGAACTGGGATGTGGAGCTGGAAGTGCCTCCTCTTCTGGGCTGTGCTGGTCACAGCCACACTCTGCACCGCTAGGCCGTCCCCGACCTTGCCTGAACAAGGATGGCAGCTGTGACCCGGGATTTCGGTGAGATGCTTCTGCACTCTGGCCGGGTCCTGCCAGCCGAAGCCCAGCCCTGGGGAGCCCCTGTGGAAGTGGAGTCCTTCCTGGTCCACCCCGGTGACCTGCTGCAGCTTCGCTGTCGGCTGCGGGACGATGTGCAGAGCATCAACTGGCTGCGGGACGGGGTGCAGCTGGCGGAAAGCAACCGCACCCGCATCACAGGGGAGGAGGTGGAGGTGCAGGACTCCGTGCCCGCAGACTCCGGCCTCTATGCTTGCGTAACCAGCAGCCCCTCGGGCAGTGACACCACCTACTTCTCCGTCAATGTTTCAGATGCTCTCCCCTCCTCGGAGGATGATGATGATGATGATGACTCCTCTTCAGAGGAGAAAGAAACAGATAACACCAAACCAAACCGTATGCCCGTAGCTCCATATTGGACATCCCCAGAAAAGATGGAAAAGAAATTGCATGCAGTGCCGGCTGCCAAGACAGTGAAGTTCAAATGCCCTTCCAGTGGGACCCCAAACCCCACACTGCGCTGGTTGAAAAATGGCAAAGAATTCAAACCTGACCACAGAATTGGAGGCTACAAGGTCCGTTATGCCACCTGGAGCATCATAATGGACTCTGTGGTGCCCTCTGACAAGGGCAACTACACCTGCATTGTGGAGAATGAGTACGGCAGCATCAACCACACATACCAGCTGGATGTCGTGGAGCGGTCCCCTCACCGGCCCATCCTGCAAGCAGGGTTGCCCGCCAACAAAACAGTGGCCCTGGGTAGCAACGTGGAGTTCATGTGTAAGGTGTACAGTGACCCGCAGCCGCACATCCAGTGGCTAAAGCACATCGAGGTGAATGGGAGCAAGATTGGCCCAGACAACCTGCCTTATGTCCAGATCTTGAAGACTGCTGGAGTTAATACCACCGACAAAGAGATGGAGGTGCTTCACTTAAGAAATGTCTCCTTTGAGGACGCAGGGGAGTATACGTGCTTGGCGGGTAACTCTATCGGACTCTCCCATCACTCTGCATGGTTGACCGTTCTGGAAGCCCTGGAAGAGAGGCCGGCAGTGATGACCTCGCCCCTGTACCTGGAGATCATCATCTATTGCACAGGGGCCTTCCTCATCTCCTGCATGGTGGGGTCGGTCATCGTCTACAAGATGAAGAGTGGTACCAAGAAGAGTGACTTCCACAGCCAGATGGCTGTGCACAAGCTGGCCAAGAGCATCCCTCTGCGCAGACAGGTGTCTGCTGACTCCAGTGCATCCATGAACTCTGGGGTTCTTCTGGTTCGGCCATCACGGCTCTCCTCCAGTGGGACTCCCATGCTAGCAGGGGTCTCTGAGTATGAGCTTCCCGAAGACCCTCGCTGGGAGCTGCCTCGGGACAGACTGGTCTTAGGCAAACCCCTGGGAGAGGGCTGCTTTGGGCAGGTGGTGTTGGCAGAGGCTATCGGGCTGGACAAGGACAAACCCAACCGTGTGACCAAAGTGGCTGTGAAGATGTTGAAGTCGGACGCAACAGAGAAAGACTTGTCAGACCTGATCTCAGAAATGGAGATGATGAAGATGATCGGGAAGCATAAGAATATCATCAACCTGCTGGGGGCCTGCACGCAGGATGGTCCCTTGTATGTCATCGTGGAGTATGCCTCCAAGGGCAACCTGCGGGAGTACCTGCAGGCCCGGAGGCCCCCAGGGCTGGAATACTGCTACAACCCCAGCCACAACCCAGAGGAGCAGCTCTCCTCCAAGGACCTGGTGTCCTGCGCCTACCAGGTGGCCCGAGGCATGGAGTATCTGGCCTCCAAGAAGTGCATACACCGAGACCTGGCAGCCAGGAATGTCCTGGTGACAGAGGACAATGTGATGAAGATAGCAGACTTTGGCCTCGCACGGGACATTCACCACATCGACTACTATAAAAAGACAACCAACGGCCGACTGCCTGTGAAGTGGATGGCACCCGAGGCATTATTTGACCGGATCTACACCCACCAGAGTGATGTGTGGTCTTTCGGGGTGCTCCTGTGGGAGATCTTCACTCTGGGCGGCTCCCCATACCCCGGTGTGCCTGTGGAGGAACTTTTCAAGCTGCTGAAGGAGGGTCACCGCATGGACAAGCCCAGTAACTGCACCAACGAGCTGTACATGATGATGCGGGACTGCTGGCATGCAGTGCCCTCACAGAGACCCACCTTCAAGCAGCTGGTGGAAGACCTGGACCGCATCGTGGCCTTGACCTCCAACCAGGAGTACCTGGACCTGTCCATGCCCCTGGACCAGTACTCCCCCAGCTTTCCCGACACCCGGAGCTCTACGTGCTCCTCAGGGGAGGATTCCGTCTTCTCTCATGAGCCGCTGCCCGAGGAGCCCTGCCTGCCCCGACACCCAGCCCAGCTTGCCAATGGCGGACTCAAACGCCGCTGACTGCCACCCACACGCCCTCCCCAGACTCCACCGTCAGCTGTAACCCTCACCCACAGCCCCTGCTGGGCCCACCACCTGTCCGTCCCTGTCCCCTTTCCTGCTGGCAGGAGCCGGCTGCCTACCAGGGGCCTTCCTGTGTGGCCTGCCTTCACCCCACTCAGCTCACCTCTCCCTCCACCTCCTCTCCACCTGCTGGTGAGAGGTGCAAAGAGGCAGATCTTTGCTGCCAGCCACTTCATCCCCTCCCAGATGTTGGACCAACACCCCTCCCTGCCACCAGGCACTGCCTGGAGGGCAGGGAGTGGGAGCCAATGAACAGGCATGCAAGTGAGAGCTTCCTGAGCTTTCTCCTGTCGGTTTGGTCTGTTTTGCCTTCACCCATAAGCCCCTCGCACTCTGGTGGCAGGTGCCTTGTCCTCAGGGCTACAGCAGTAGGGAGGTCAGTGCTTCGTGCCTCGATTGAAGGTGACCTCTGCCCCAGATAGGTGGTGCCAGTGGCTTATTAATTCCGATACTAGTTTGCTTTGCTGACCAAATGCCTGGTACCAGAGGATGGTGAGGCGAAGGCCAGGTTGGGGGCAGTGTTGTGGCCCTGGGGCCCAGCCCCAAACTGGGGGCTCTGTATATAGCTATGAAGAAAACACAAAGTGTATAAATCTGAGTATATATTTACATGTCTTTTTAAAAGGGTCGTTACCAGAGATTTACCCATCGGGTAAGATGCTCCTGGTGGCTGGGAGGCATCAGTTGCTATATATTAAAAACAAAAAAGAAAAAAAAGGAAAATGTTTTTAAAAAGGTCATATATTTTTTGCTACTTTTGCTGTTTTATTTTTTTAAATTATGTTCTAAACCTATTTTCAGTTTAGGTCCCTCAATAAAAATTGCTGCTGCTTC

SEQ ID NO: 10 - protein, 812 aa, Homo sapiens
MAAVTRDFGEMLLHSGRVLPAEAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 11 - protein, 3824 aa, Homo sapiens
CTTGCGGCCACAGGCGCGGCGTCCTCGGCGGCGGGCGGCAGCTAGCGGGAGCCGGGACGCCGGTGCAGCCGCAGCGCGCGGAGGAACCCGGGTGTGCCGGGAGCTGGGCGGCCACGTCCGGACGGGACCGAGACCCCTCGTAGCGCATTGCGGCGACCTCGCCTTCCCCGGCCGCGAGCGCGCCGCTGCTTGAAAAGCCGCGGAACCCAAGGACTTTTCTCCGGTCCGAGCTCGGGGCGCCCCGCAGGGCGCACGGTACCCGTGCTGCAGTCGGGCACGCCGCGGCGCCGGGGCCTCCGCAGGGCGATGGAGCCCGGTCTGCAAGGAAAGTGAGGCGCCGCCGCTGCGTTCTGGAGGAGGGGGGCACAAGGTCTGGAGACCCCGGGTGGCGGACGGGAGCCCTCCCCCCGCCCCGCCTCCGGGGCACCAGCTCCGGCTCCATTGTTCCCGCCCGGGCTGGAGGCGCCGAGCACCGAGCGCCGCCGGGAGTCGAGCGCCGGCCGCGGAGCTCTTGCGACCCCGCCAGGACCCGAACAGAGCCCGGGGGCGGCGGGCCGGAGCCGGGGACGCGGGCACACGCCCGCTCGCACAAGCCACGGCGGACTCTCCCGAGGCGGAACCTCCACGCCGAGCGAGGGTCAGTTTGAAAAGGAGGATCGAGCTCACTGTGGAGTATCCATGGAGATGTGGAGCCTTGTCACCAACCTCTAACTGCAGAACTGGGATGTGGAGCTGGAAGTGCCTCCTCTTCTGGGCTGTGCTGGTCACAGCCACACTCTGCACCGCTAGGCCGTCCCCGACCTTGCCTGAACAAGATGCTCTCCCCTCCTCGGAGGATGATGATGATGATGATGACTCCTCTTCAGAGGAGAAAGAAACAGATAACACCAAACCAAACCGTATGCCCGTAGCTCCATATTGGACATCCCCAGAAAAGATGGAAAAGAAATTGCATGCAGTGCCGGCTGCCAAGACAGTGAAGTTCAAATGCCCTTCCAGTGGGACCCCAAACCCCACACTGCGCTGGTTGAAAAATGGCAAAGAATTCAAACCTGACCACAGAATTGGAGGCTACAAGGTCCGTTATGCCACCTGGAGCATCATAATGGACTCTGTGGTGCCCTCTGACAAGGGCAACTACACCTGCATTGTGGAGAATGAGTACGGCAGCATCAACCACACATACCAGCTGGATGTCGTGGAGCGGTCCCCTCACCGGCCCATCCTGCAAGCAGGGTTGCCCGCCAACAAAACAGTGGCCCTGGGTAGCAACGTGGAGTTCATGTGTAAGGTGTACAGTGACCCGCAGCCGCACATCCAGTGGCTAAAGCACATCGAGGTGAATGGGAGCAAGATTGGCCCAGACAACCTGCCTTATGTCCAGATCTTGAAGACTGCTGGAGTTAATACCACCGACAAAGAGATGGAGGTGCTTCACTTAAGAAATGTCTCCTTTGAGGACGCAGGGGAGTATACGTGCTTGGCGGGTAACTCTATCGGACTCTCCCATCACTCTGCATGGTTGACCGTTCTGGAAGCCCTGGAAGAGAGGCCGGCAGTGATGACCTCGCCCCTGTACCTGGAGATCATCATCTATTGCACAGGGGCCTTCCTCATCTCCTGCATGGTGGGGTCGGTCATCGTCTACAAGATGAAGAGTGGTACCAAGAAGAGTGACTTCCACAGCCAGATGGCTGTGCACAAGCTGGCCAAGAGCATCCCTCTGCGCAGACAGGTAACAGTGTCTGCTGACTCCAGTGCATCCATGAACTCTGGGGTTCTTCTGGTTCGGCCATCACGGCTCTCCTCCAGTGGGACTCCCATGCTAGCAGGGGTCTCTGAGTATGAGCTTCCCGAAGACCCTCGCTGGGAGCTGCCTCGGGACAGACTGGTCTTAGGCAAACCCCTGGGAGAGGGCTGCTTTGGGCAGGTGGTGTTGGCAGAGGCTATCGGGCTGGACAAGGACAAACCCAACCGTGTGACCAAAGTGGCTGTGAAGATGTTGAAGTCGGACGCAACAGAGAAAGACTTGTCAGACCTGATCTCAGAAATGGAGATGATGAAGATGATCGGGAAGCATAAGAATATCATCAACCTGCTGGGGGCCTGCACGCAGGATGGTCCCTTGTATGTCATCGTGGAGTATGCCTCCAAGGGCAACCTGCGGGAGTACCTGCAGGCCCGGAGGCCCCCAGGGCTGGAATACTGCTACAACCCCAGCCACAACCCAGAGGAGCAGCTCTCCTCCAAGGACCTGGTGTCCTGCGCCTACCAGGTGGCCCGAGGCATGGAGTATCTGGCCTCCAAGAAGTGCATACACCGAGACCTGGCAGCCAGGAATGTCCTGGTGACAGAGGACAATGTGATGAAGATAGCAGACTTTGGCCTCGCACGGGACATTCACCACATCGACTACTATAAAAAGACAACCAACGGCCGACTGCCTGTGAAGTGGATGGCACCCGAGGCATTATTTGACCGGATCTACACCCACCAGAGTGATGTGTGGTCTTTCGGGGTGCTCCTGTGGGAGATCTTCACTCTGGGCGGCTCCCCATACCCCGGTGTGCCTGTGGAGGAACTTTTCAAGCTGCTGAAGGAGGGTCACCGCATGGACAAGCCCAGTAACTGCACCAACGAGCTGTACATGATGATGCGGGACTGCTGGCATGCAGTGCCCTCACAGAGACCCACCTTCAAGCAGCTGGTGGAAGACCTGGACCGCATCGTGGCCTTGACCTCCAACCAGGAGTACCTGGACCTGTCCATGCCCCTGGACCAGTACTCCCCCAGCTTTCCCGACACCCGGAGCTCTACGTGCTCCTCAGGGGAGGATTCCGTCTTCTCTCATGAGCCGCTGCCCGAGGAGCCCTGCCTGCCCCGACACCCAGCCCAGCTTGCCAATGGCGGACTCAAACGCCGCTGACTGCCACCCACACGCCCTCCCCAGACTCCACCGTCAGCTGTAACCCTCACCCACAGCCCCTGCTGGGCCCACCACCTGTCCGTCCCTGTCCCCTTTCCTGCTGGCAGGAGCCGGCTGCCTACCAGGGGCCTTCCTGTGTGGCCTGCCTTCACCCCACTCAGCTCACCTCTCCCTCCACCTCCTCTCCACCTGCTGGTGAGAGGTGCAAAGAGGCAGATCTTTGCTGCCAGCCACTTCATCCCCTCCCAGATGTTGGACCAACACCCCTCCCTGCCACCAGGCACTGCCTGGAGGGCAGGGAGTGGGAGCCAATGAACAGGCATGCAAGTGAGAGCTTCCTGAGCTTTCTCCTGTCGGTTTGGTCTGTTTTGCCTTCACCCATAAGCCCCTCGCACTCTGGTGGCAGGTGCCTTGTCCTCAGGGCTACAGCAGTAGGGAGGTCAGTGCTTCGTGCCTCGATTGAAGGTGACCTCTGCCCCAGATAGGTGGTGCCAGTGGCTTATTAATTCCGATACTAGTTTGCTTTGCTGACCAAATGCCTGGTACCAGAGGATGGTGAGGCGAAGGCCAGGTTGGGGGCAGTGTTGTGGCCCTGGGGCCCAGCCCCAAACTGGGGGCTCTGTATATAGCTATGAAGAAAACACAAAGTGTATAAATCTGAGTATATATTTACATGTCTTTTTAAAAGGGTCGTTACCAGAGATTTACCCATCGGGTAAGATGCTCCTGGTGGCTGGGAGGCATCAGTTGCTATATATTAAAAACAAAAAAGAAAAAAAAGGAAAATGTTTTTAAAAAGGTCATATATTTTTTGCTACTTTTGCTGTTTTATTTTTTTAAATTATGTTCTAAACCTATTTTCAGTTTAGGTCCCTCAATAAAAATTGCTGCTGCTTCA

SEQ ID NO: 12 - protein, 733 aa, Homo sapiens
MWSWKCLLFWAVLVTATLCTARPSPTLPEQDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 13 - protein, 3816 aa, Homo sapiens
CTTGCGGCCACAGGCGCGGCGTCCTCGGCGGCGGGCGGCAGCTAGCGGGAGCCGGGACGCCGGTGCAGCCGCAGCGCGCGGAGGAACCCGGGTGTGCCGGGAGCTGGGCGGCCACGTCCGGACGGGACCGAGACCCCTCGTAGCGCATTGCGGCGACCTCGCCTTCCCCGGCCGCGAGCGCGCCGCTGCTTGAAAAGCCGCGGAACCCAAGGACTTTTCTCCGGTCCGAGCTCGGGGCGCCCCGCAGGGCGCACGGTACCCGTGCTGCAGTCGGGCACGCCGCGGCGCCGGGGCCTCCGCAGGGCGATGGAGCCCGGTCTGCAAGGAAAGTGAGGCGCCGCCGCTGCGTTCTGGAGGAGGGGGGCACAAGGTCTGGAGACCCCGGGTGGCGGACGGGAGCCCTCCCCCCGCCCCGCCTCCGGGGCACCAGCTCCGGCTCCATTGTTCCCGCCCGGGCTGGAGGCGCCGAGCACCGAGCGCCGCCGGGAGTCGAGCGCCGGCCGCGGAGCTCTTGCGACCCCGCCAGGACCCGAACAGAGCCCGGGGGCGGCGGGCCGGAGCCGGGGACGCGGGCACACGCCCGCTCGCACAAGCCACGGCGGACTCTCCCGAGGCGGAACCTCCACGCCGAGCGAGGGTCAGTTTGAAAAGGAGGATCGAGCTCACTGTGGAGTATCCATGGAGATGTGGAGCCTTGTCACCAACCTCTAACTGCAGAACTGGGATGTGGAGCTGGAAGTGCCTCCTCTTCTGGGCTGTGCTGGTCACAGCCACACTCTGCACCGCTAGGCCGTCCCCGACCTTGCCTGAACAAGATGCTCTCCCCTCCTCGGAGGATGATGATGATGATGATGACTCCTCTTCAGAGGAGAAAGAAACAGATAACACCAAACCAAACCCCGTAGCTCCATATTGGACATCCCCAGAAAAGATGGAAAAGAAATTGCATGCAGTGCCGGCTGCCAAGACAGTGAAGTTCAAATGCCCTTCCAGTGGGACCCCAAACCCCACACTGCGCTGGTTGAAAAATGGCAAAGAATTCAAACCTGACCACAGAATTGGAGGCTACAAGGTCCGTTATGCCACCTGGAGCATCATAATGGACTCTGTGGTGCCCTCTGACAAGGGCAACTACACCTGCATTGTGGAGAATGAGTACGGCAGCATCAACCACACATACCAGCTGGATGTCGTGGAGCGGTCCCCTCACCGGCCCATCCTGCAAGCAGGGTTGCCCGCCAACAAAACAGTGGCCCTGGGTAGCAACGTGGAGTTCATGTGTAAGGTGTACAGTGACCCGCAGCCGCACATCCAGTGGCTAAAGCACATCGAGGTGAATGGGAGCAAGATTGGCCCAGACAACCTGCCTTATGTCCAGATCTTGAAGACTGCTGGAGTTAATACCACCGACAAAGAGATGGAGGTGCTTCACTTAAGAAATGTCTCCTTTGAGGACGCAGGGGAGTATACGTGCTTGGCGGGTAACTCTATCGGACTCTCCCATCACTCTGCATGGTTGACCGTTCTGGAAGCCCTGGAAGAGAGGCCGGCAGTGATGACCTCGCCCCTGTACCTGGAGATCATCATCTATTGCACAGGGGCCTTCCTCATCTCCTGCATGGTGGGGTCGGTCATCGTCTACAAGATGAAGAGTGGTACCAAGAAGAGTGACTTCCACAGCCAGATGGCTGTGCACAAGCTGGCCAAGAGCATCCCTCTGCGCAGACAGGTAACAGTGTCTGCTGACTCCAGTGCATCCATGAACTCTGGGGTTCTTCTGGTTCGGCCATCACGGCTCTCCTCCAGTGGGACTCCCATGCTAGCAGGGGTCTCTGAGTATGAGCTTCCCGAAGACCCTCGCTGGGAGCTGCCTCGGGACAGACTGGTCTTAGGCAAACCCCTGGGAGAGGGCTGCTTTGGGCAGGTGGTGTTGGCAGAGGCTATCGGGCTGGACAAGGACAAACCCAACCGTGTGACCAAAGTGGCTGTGAAGATGTTGAAGTCGGACGCAACAGAGAAAGACTTGTCAGACCTGATCTCAGAAATGGAGATGATGAAGATGATCGGGAAGCATAAGAATATCATCAACCTGCTGGGGGCCTGCACGCAGGATGGTCCCTTGTATGTCATCGTGGAGTATGCCTCCAAGGGCAACCTGCGGGAGTACCTGCAGGCCCGGAGGCCCCCAGGGCTGGAATACTGCTACAACCCCAGCCACAACCCAGAGGAGCAGCTCTCCTCCAAGGACCTGGTGTCCTGCGCCTACCAGGTGGCCCGAGGCATGGAGTATCTGGCCTCCAAGAAGTGCATACACCGAGACCTGGCAGCCAGGAATGTCCTGGTGACAGAGGACAATGTGATGAAGATAGCAGACTTTGGCCTCGCACGGGACATTCACCACATCGACTACTATAAAAAGACAACCAACGGCCGACTGCCTGTGAAGTGGATGGCACCCGAGGCATTATTTGACCGGATCTACACCCACCAGAGTGATGTGTGGTCTTTCGGGGTGCTCCTGTGGGAGATCTTCACTCTGGGCGGCTCCCCATACCCCGGTGTGCCTGTGGAGGAACTTTTCAAGCTGCTGAAGGAGGGTCACCGCATGGACAAGCCCAGTAACTGCACCAACGAGCTGTACATGATGATGCGGGACTGCTGGCATGCAGTGCCCTCACAGAGACCCACCTTCAAGCAGCTGGTGGAAGACCTGGACCGCATCGTGGCCTTGACCTCCAACCAGGAGTACCTGGACCTGTCCATGCCCCTGGACCAGTACTCCCCCAGCTTTCCCGACACCCGGAGCTCTACGTGCTCCTCAGGGGAGGATTCCGTCTTCTCTCATGAGCCGCTGCCCGAGGAGCCCTGCCTGCCCCGACACCCAGCCCAGCTTGCCAATGGCGGACTCAAACGCCGCTGACTGCCACCCACACGCCCTCCCCAGACTCCACCGTCAGCTGTAACCCTCACCCACAGCCCCTGCTGGGCCCACCACCTGTCCGTCCCTGTCCCCTTTCCTGCTGGCAGGAGCCGGCTGCCTACCAGGGGCCTTCCTGTGTGGCCTGCCTTCACCCCACTCAGCTCACCTCTCCCTCCACCTCCTCTCCACCTGCTGGTGAGAGGTGCAAAGAGGCAGATCTTTGCTGCCAGCCACTTCATCCCCTCCCAGATGTTGGACCAACACCCCTCCCTGCCACCAGGCACTGCCTGGAGGGCAGGGAGTGGGAGCCAATGAACAGGCATGCAAGTGAGAGCTTCCTGAGCTTTCTCCTGTCGGTTTGGTCTGTTTTGCCTTCACCCATAAGCCCCTCGCACTCTGGTGGCAGGTGCCTTGTCCTCAGGGCTACAGCAGTAGGGAGGTCAGTGCTTCGTGCCTCGATTGAAGGTGACCTCTGCCCCAGATAGGTGGTGCCAGTGGCTTATTAATTCCGATACTAGTTTGCTTTGCTGACCAAATGCCTGGTACCAGAGGATGGTGAGGCGAAGGCCAGGTTGGGGGCAGTGTTGTGGCCCTGGGGCCCAGCCCCAAACTGGGGGCTCTGTATATAGCTATGAAGAAAACACAAAGTGTATAAATCTGAGTATATATTTACATGTCTTTTTAAAAGGGTCGTTACCAGAGATTTACCCATCGGGTAAGATGCTCCTGGTGGCTGGGAGGCATCAGTTGCTATATATTAAAAACAAAAAAGAAAAAAAAGGAAAATGTTTTTAAAAAGGTCATATATTTTTTGCTACTTTTGCTGTTTTATTTTTTTAAATTATGTTCTAAACCTATTTTCAGTTTAGGTCCCTCAATAAAAATTGCTGCTGCTT

SEQ ID NO: 14 - protein, 731 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 15 - protein, 3680 aa, Homo sapiens
GCTTTGCCCGCCGCAGCCCAGCCGGGGCCGGCGCCTCCCTCCGCTCGCCGCCCGCCCCTTTCACCTCCTGGCTCCCTCCCGGGCGATCCGCGCCCCTTGGGTCTCCCCTCCCTTCCCTCCGTCCGCGTCTCCTGCGCCCCCTCCCTGCGCTCGTCCCGCCGCTCTTCCCGCCGCCCAACTTTTCCTCCAACTCGCGCTCGGGAGCTGGCGAGGCGGCGGCGGCTCCTCAGGTCAGTTTGAAAAGGAGGATCGAGCTCACTGTGGAGTATCCATGGAGATGTGGAGCCTTGTCACCAACCTCTAACTGCAGAACTGGGATGTGGAGCTGGAAGTGCCTCCTCTTCTGGGCTGTGCTGGTCACAGCCACACTCTGCACCGCTAGGCCGTCCCCGACCTTGCCTGAACAAGCCCAGCCCTGGGGAGCCCCTGTGGAAGTGGAGTCCTTCCTGGTCCACCCCGGTGACCTGCTGCAGCTTCGCTGTCGGCTGCGGGACGATGTGCAGAGCATCAACTGGCTGCGGGACGGGGTGCAGCTGGCGGAAAGCAACCGCACCCGCATCACAGGGGAGGAGGTGGAGGTGCAGGACTCCGTGCCCGCAGACTCCGGCCTCTATGCTTGCGTAACCAGCAGCCCCTCGGGCAGTGACACCACCTACTTCTCCGTCAATGTTTCAGATGCTCTCCCCTCCTCGGAGGATGATGATGATGATGATGACTCCTCTTCAGAGGAGAAAGAAACAGATAACACCAAACCAAACCCCGTAGCTCCATATTGGACATCCCCAGAAAAGATGGAAAAGAAATTGCATGCAGTGCCGGCTGCCAAGACAGTGAAGTTCAAATGCCCTTCCAGTGGGACCCCAAACCCCACACTGCGCTGGTTGAAAAATGGCAAAGAATTCAAACCTGACCACAGAATTGGAGGCTACAAGGTCCGTTATGCCACCTGGAGCATCATAATGGACTCTGTGGTGCCCTCTGACAAGGGCAACTACACCTGCATTGTGGAGAATGAGTACGGCAGCATCAACCACACATACCAGCTGGATGTCGTGGAGCGGTCCCCTCACCGGCCCATCCTGCAAGCAGGGTTGCCCGCCAACAAAACAGTGGCCCTGGGTAGCAACGTGGAGTTCATGTGTAAGGTGTACAGTGACCCGCAGCCGCACATCCAGTGGCTAAAGCACATCGAGGTGAATGGGAGCAAGATTGGCCCAGACAACCTGCCTTATGTCCAGATCTTGAAGACTGCTGGAGTTAATACCACCGACAAAGAGATGGAGGTGCTTCACTTAAGAAATGTCTCCTTTGAGGACGCAGGGGAGTATACGTGCTTGGCGGGTAACTCTATCGGACTCTCCCATCACTCTGCATGGTTGACCGTTCTGGAAGCCCTGGAAGAGAGGCCGGCAGTGATGACCTCGCCCCTGTACCTGGAGATCATCATCTATTGCACAGGGGCCTTCCTCATCTCCTGCATGGTGGGGTCGGTCATCGTCTACAAGATGAAGAGTGGTACCAAGAAGAGTGACTTCCACAGCCAGATGGCTGTGCACAAGCTGGCCAAGAGCATCCCTCTGCGCAGACAGGTAACAGTGTCTGCTGACTCCAGTGCATCCATGAACTCTGGGGTTCTTCTGGTTCGGCCATCACGGCTCTCCTCCAGTGGGACTCCCATGCTAGCAGGGGTCTCTGAGTATGAGCTTCCCGAAGACCCTCGCTGGGAGCTGCCTCGGGACAGACTGGTCTTAGGCAAACCCCTGGGAGAGGGCTGCTTTGGGCAGGTGGTGTTGGCAGAGGCTATCGGGCTGGACAAGGACAAACCCAACCGTGTGACCAAAGTGGCTGTGAAGATGTTGAAGTCGGACGCAACAGAGAAAGACTTGTCAGACCTGATCTCAGAAATGGAGATGATGAAGATGATCGGGAAGCATAAGAATATCATCAACCTGCTGGGGGCCTGCACGCAGGATGGTCCCTTGTATGTCATCGTGGAGTATGCCTCCAAGGGCAACCTGCGGGAGTACCTGCAGGCCCGGAGGCCCCCAGGGCTGGAATACTGCTACAACCCCAGCCACAACCCAGAGGAGCAGCTCTCCTCCAAGGACCTGGTGTCCTGCGCCTACCAGGTGGCCCGAGGCATGGAGTATCTGGCCTCCAAGAAGTGCATACACCGAGACCTGGCAGCCAGGAATGTCCTGGTGACAGAGGACAATGTGATGAAGATAGCAGACTTTGGCCTCGCACGGGACATTCACCACATCGACTACTATAAAAAGACAACCAACGGCCGACTGCCTGTGAAGTGGATGGCACCCGAGGCATTATTTGACCGGATCTACACCCACCAGAGTGATGTGTGGTCTTTCGGGGTGCTCCTGTGGGAGATCTTCACTCTGGGCGGCTCCCCATACCCCGGTGTGCCTGTGGAGGAACTTTTCAAGCTGCTGAAGGAGGGTCACCGCATGGACAAGCCCAGTAACTGCACCAACGAGCTGTACATGATGATGCGGGACTGCTGGCATGCAGTGCCCTCACAGAGACCCACCTTCAAGCAGCTGGTGGAAGACCTGGACCGCATCGTGGCCTTGACCTCCAACCAGGAGTACCTGGACCTGTCCATGCCCCTGGACCAGTACTCCCCCAGCTTTCCCGACACCCGGAGCTCTACGTGCTCCTCAGGGGAGGATTCCGTCTTCTCTCATGAGCCGCTGCCCGAGGAGCCCTGCCTGCCCCGACACCCAGCCCAGCTTGCCAATGGCGGACTCAAACGCCGCTGACTGCCACCCACACGCCCTCCCCAGACTCCACCGTCAGCTGTAACCCTCACCCACAGCCCCTGCTGGGCCCACCACCTGTCCGTCCCTGTCCCCTTTCCTGCTGGCAGGAGCCGGCTGCCTACCAGGGGCCTTCCTGTGTGGCCTGCCTTCACCCCACTCAGCTCACCTCTCCCTCCACCTCCTCTCCACCTGCTGGTGAGAGGTGCAAAGAGGCAGATCTTTGCTGCCAGCCACTTCATCCCCTCCCAGATGTTGGACCAACACCCCTCCCTGCCACCAGGCACTGCCTGGAGGGCAGGGAGTGGGAGCCAATGAACAGGCATGCAAGTGAGAGCTTCCTGAGCTTTCTCCTGTCGGTTTGGTCTGTTTTGCCTTCACCCATAAGCCCCTCGCACTCTGGTGGCAGGTGCCTTGTCCTCAGGGCTACAGCAGTAGGGAGGTCAGTGCTTCGTGCCTCGATTGAAGGTGACCTCTGCCCCAGATAGGTGGTGCCAGTGGCTTATTAATTCCGATACTAGTTTGCTTTGCTGACCAAATGCCTGGTACCAGAGGATGGTGAGGCGAAGGCCAGGTTGGGGGCAGTGTTGTGGCCCTGGGGCCCAGCCCCAAACTGGGGGCTCTGTATATAGCTATGAAGAAAACACAAAGTGTATAAATCTGAGTATATATTTACATGTCTTTTTAAAAGGGTCGTTACCAGAGATTTACCCATCGGGTAAGATGCTCCTGGTGGCTGGGAGGCATCAGTTGCTATATATTAAAAACAAAAAAGAAAAAAAAGGAAAATGTTTTTAAAAAGGTCATATATTTTTTGCTACTTTTGCTGTTTTATTTTTTTAAATTATGTTCTAAACCTATTTTCAGTTTAGGTCCCTCAATAAAAATTGCTGCTGCTTCATT

SEQ ID NO: 16 - protein, 820 aa, Homo sapiens; identical to SEQ ID NO: 4

SEQ ID NO: 17 - protein, 2870 aa, Homo sapiens
AACTTTTCCTCCAACTCGCGCTCGGGAGCTGGCGAGGCGGCGGCGGCTCCTCAAAGTGGGAGAGCTTCAAGGTCACGTGGTCCGTCCAGCCCCTGCTATCTCACCAGACACTGTCCACCCTGTATGTTGGATCAGTACTCCAGTGAGAAGACAGCAGGCACTTTCACCCATGCAGCCCATTCAGTCTTCATAACCACCTGTGATGGAGGCAAGGGTCAGTTTGAAAAGGAGGATCGAGCTCACTGTGGAGTATCCATGGAGATGTGGAGCCTTGTCACCAACCTCTAACTGCAGAACTGGGATGTGGAGCTGGAAGTGCCTCCTCTTCTGGGCTGTGCTGGTCACAGCCACACTCTGCACCGCTAGGCCGTCCCCGACCTTGCCTGAACAAGCCCAGCCCTGGGGAGCCCCTGTGGAAGTGGAGTCCTTCCTGGTCCACCCCGGTGACCTGCTGCAGCTTCGCTGTCGGCTGCGGGACGATGTGCAGAGCATCAACTGGCTGCGGGACGGGGTGCAGCTGGCGGAAAGCAACCGCACCCGCATCACAGGGGAGGAGGTGGAGGTGCAGGACTCCGTGCCCGCAGACTCCGGCCTCTATGCTTGCGTAACCAGCAGCCCCTCGGGCAGTGACACCACCTACTTCTCCGTCAATGTTTCAGATGCTCTCCCCTCCTCGGAGGATGATGATGATGATGATGACTCCTCTTCAGAGGAGAAAGAAACAGATAACACCAAACCAAACCCCGTAGCTCCATATTGGACATCCCCAGAAAAGATGGAAAAGAAATTGCATGCAGTGCCGGCTGCCAAGACAGTGAAGTTCAAATGCCCTTCCAGTGGGACCCCAAACCCCACACTGCGCTGGTTGAAAAATGGCAAAGAATTCAAACCTGACCACAGAATTGGAGGCTACAAGGTCCGTTATGCCACCTGGAGCATCATAATGGACTCTGTGGTGCCCTCTGACAAGGGCAACTACACCTGCATTGTGGAGAATGAGTACGGCAGCATCAACCACACATACCAGCTGGATGTCGTGGAGCGGTCCCCTCACCGGCCCATCCTGCAAGCAGGGTTGCCCGCCAACAAAACAGTGGCCCTGGGTAGCAACGTGGAGTTCATGTGTAAGGTGTACAGTGACCCGCAGCCGCACATCCAGTGGCTAAAGCACATCGAGGTGAATGGGAGCAAGATTGGCCCAGACAACCTGCCTTATGTCCAGATCTTGAAGACTGCTGGAGTTAATACCACCGACAAAGAGATGGAGGTGCTTCACTTAAGAAATGTCTCCTTTGAGGACGCAGGGGAGTATACGTGCTTGGCGGGTAACTCTATCGGACTCTCCCATCACTCTGCATGGTTGACCGTTCTGGAAGCCCTGGAAGAGAGGCCGGCAGTGATGACCTCGCCCCTGTACCTGGAGATCATCATCTATTGCACAGGGGCCTTCCTCATCTCCTGCATGGTGGGGTCGGTCATCGTCTACAAGATGAAGAGTGGTACCAAGAAGAGTGACTTCCACAGCCAGATGGCTGTGCACAAGCTGGCCAAGAGCATCCCTCTGCGCAGACAGGTAACAGTGTCTGCTGACTCCAGTGCATCCATGAACTCTGGGGTTCTTCTGGTTCGGCCATCACGGCTCTCCTCCAGTGGGACTCCCATGCTAGCAGGGGTCTCTGAGTATGAGCTTCCCGAAGACCCTCGCTGGGAGCTGCCTCGGGACAGACTGGTCTTAGGCAAACCCCTGGGAGAGGGCTGCTTTGGGCAGGTGGTGTTGGCAGAGGCTATCGGGCTGGACAAGGACAAACCCAACCGTGTGACCAAAGTGGCTGTGAAGATGTTGAAGTCGGACGCAACAGAGAAAGACTTGTCAGACCTGATCTCAGAAATGGAGATGATGAAGATGATCGGGAAGCATAAGAATATCATCAACCTGCTGGGGGCCTGCACGCAGGATGGTCCCTTGTATGTCATCGTGGAGTATGCCTCCAAGGGCAACCTGCGGGAGTACCTGCAGGCCCGGAGGCCCCCAGGGCTGGAATACTGCTACAACCCCAGCCACAACCCAGAGGAGCAGCTCTCCTCCAAGGACCTGGTGTCCTGCGCCTACCAGGTGGCCCGAGGCATGGAGTATCTGGCCTCCAAGAAGTGCATACACCGAGACCTGGCAGCCAGGAATGTCCTGGTGACAGAGGACAATGTGATGAAGATAGCAGACTTTGGCCTCGCACGGGACATTCACCACATCGACTACTATAAAAAGACAACCAACGGCCGACTGCCTGTGAAGTGGATGGCACCCGAGGCATTATTTGACCGGATCTACACCCACCAGAGTGATGTGTGGTCTTTCGGGGTGCTCCTGTGGGAGATCTTCACTCTGGGCGGCTCCCCATACCCCGGTGTGCCTGTGGAGGAACTTTTCAAGCTGCTGAAGGAGGGTCACCGCATGGACAAGCCCAGTAACTGCACCAACGAGCTGTACATGATGATGCGGGACTGCTGGCATGCAGTGCCCTCACAGAGACCCACCTTCAAGCAGCTGGTGGAAGACCTGGACCGCATCGTGGCCTTGACCTCCAACCAGGAGTACCTGGACCTGTCCATGCCCCTGGACCAGTACTCCCCCAGCTTTCCCGACACCCGGAGCTCTACGTGCTCCTCAGGGGAGGATTCCGTCTTCTCTCATGAGCCGCTGCCCGAGGAGCCCTGCCTGCCCCGACACCCAGCCCAGCTTGCCAATGGCGGACTCAAACGCCGCTGACTGCCACCCACACGCCCTCCCCAGACTCCACCGTCAGCTGTAACCCTCACCCACAGCCCCTGCTGGGCCCACCACCTGTCCGTCCCTGTCCCCTTTCCTGCTGGCA

SEQ ID NO: 18 - protein, 820 aa, Homo sapiens; identical to SEQ ID NO: 4

SEQ ID NO: 19 - protein, 4369 aa, Homo sapiens
GGCGGCGGCTGGAGGAGAGCGCGGTGGAGAGCCGAGCGGGCGGGCGGCGGGTGCGGAGCGGGCGAGGGAGCGCGCGCGGCCGCCACAAAGCTCGGGCGCCGCGGGGCTGCATGCGGCGTACCTGGCCCGGCGCGGCGACTGCTCTCCGGGCTGGCGGGGGCCGGCCGCGAGCCCCGGGGGCCCCGAGGCCGCAGCTTGCCTGCGCGCTCTGAGCCTTCGCAACTCGCGAGCAAAGTTTGGTGGAGGCAACGCCAAGCCTGAGTCCTTTCTTCCTCTCGTTCCCCAAATCCGAGGGCAGCCCGCGGGCGTCATGCCCGCGCTCCTCCGCAGCCTGGGGTACGCGTGAAGCCCGGGAGGCTTGGCGCCGGCGAAGACCCAAGGACCACTCTTCTGCGTTTGGAGTTGCTCCCCGCAACCCCGGGCTCGTCGCTTTCTCCATCCCGACCCACGCGGGGCGCGGGGACAACACAGGTCGCGGAGGAGCGTTGCCATTCAAGTGACTGCAGCAGCAGCGGCAGCGCCTCGGTTCCTGAGCCCACCGCAGGCTGAAGGCATTGCGCGTAGTCCATGCCCGTAGAGGAAGTGTGCAGATGGGATTAACGTCCACATGGAGATATGGAAGAGGACCGGGGATTGGTACCGTAACCATGGTCAGCTGGGGTCGTTTCATCTGCCTGGTCGTGGTCACCATGGCAACCTTGTCCCTGGCCCGGCCCTCCTTCAGTTTAGTTGAGGATACCACATTAGAGCCAGAAGATGCCATCTCATCCGGAGATGATGAGGATGACACCGATGGTGCGGAAGATTTTGTCAGTGAGAACAGTAACAACAAGAGAGCACCATACTGGACCAACACAGAAAAGATGGAAAAGCGGCTCCATGCTGTGCCTGCGGCCAACACTGTCAAGTTTCGCTGCCCAGCCGGGGGGAACCCAATGCCAACCATGCGGTGGCTGAAAAACGGGAAGGAGTTTAAGCAGGAGCATCGCATTGGAGGCTACAAGGTACGAAACCAGCACTGGAGCCTCATTATGGAAAGTGTGGTCCCATCTGACAAGGGAAATTATACCTGTGTAGTGGAGAATGAATACGGGTCCATCAATCACACGTACCACCTGGATGTTGTGGAGCGATCGCCTCACCGGCCCATCCTCCAAGCCGGACTGCCGGCAAATGCCTCCACAGTGGTCGGAGGAGACGTAGAGTTTGTCTGCAAGGTTTACAGTGATGCCCAGCCCCACATCCAGTGGATCAAGCACGTGGAAAAGAACGGCAGTAAATACGGGCCCGACGGGCTGCCCTACCTCAAGGTTCTCAAGGCCGCCGGTGTTAACACCACGGACAAAGAGATTGAGGTTCTCTATATTCGGAATGTAACTTTTGAGGACGCTGGGGAATATACGTGCTTGGCGGGTAATTCTATTGGGATATCCTTTCACTCTGCATGGTTGACAGTTCTGCCAGCGCCTGGAAGAGAAAAGGAGATTACAGCTTCCCCAGACTACCTGGAGATAGCCATTTACTGCATAGGGGTCTTCTTAATCGCCTGTATGGTGGTAACAGTCATCCTGTGCCGAATGAAGAACACGACCAAGAAGCCAGACTTCAGCAGCCAGCCGGCTGTGCACAAGCTGACCAAACGTATCCCCCTGCGGAGACAGGTAACAGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGGAATACTTGGACCTCAGCCAACCTCTCGAACAGTATTCACCTAGTTACCCTGACACAAGAAGTTCTTGTTCTTCAGGAGATGATTCTGTTTTTTCTCCAGACCCCATGCCTTACGAACCATGCCTTCCTCAGTATCCACACATAAACGGCAGTGTTAAAACATGAATGACTGTGTCTGCCTGTCCCCAAACAGGACAGCACTGGGAACCTAGCTACACTGAGCAGGGAGACCATGCCTCCCAGAGCTTGTTGTCTCCACTTGTATATATGGATCAGAGGAGTAAATAATTGGAAAAGTAATCAGCATATGTGTAAAGATTTATACAGTTGAAAACTTGTAATCTTCCCCAGGAGGAGAAGAAGGTTTCTGGAGCAGTGGACTGCCACAAGCCACCATGTAACCCCTCTCACCTGCCGTGCGTACTGGCTGTGGACCAGTAGGACTCAAGGTGGACGTGCGTTCTGCCTTCCTTGTTAATTTTGTAATAATTGGAGAAGATTTATGTCAGCACACACTTACAGAGCACAAATGCAGTATATAGGTGCTGGATGTATGTAAATATATTCAAATTATGTATAAATATATATTATATATTTACAAGGAGTTATTTTTTGTATTGATTTTAAATGGATGTCCCAATGCACCTAGAAAATTGGTCTCTCTTTTTTTAATAGCTATTTGCTAAATGCTGTTCTTACACATAATTTCTTAATTTTCACCGAGCAGAGGTGGAAAAATACTTTTGCTTTCAGGGAAAATGGTATAACGTTAATTTATTAATAAATTGGTAATATACAAAACAATTAATCATTTATAGTTTTTTTTGTAATTTAAGTGGCATTTCTATGCAGGCAGCACAGCAGACTAGTTAATCTATTGCTTGGACTTAACTAGTTATCAGATCCTTTGAAAAGAGAATATTTACAATATATGACTAATTTGGGGAAAATGAAGTTTTGATTTATTTGTGTTTAAATGCTGCTGTCAGACGATTGTTCTTAGACCTCCTAAATGCCCCATATTAAAAGAACTCATTCATAGGAAGGTGTTTCATTTTGGTGTGCAACCCTGTCATTACGTCAACGCAACGTCTAACTGGACTTCCCAAGATAAATGGTACCAGCGTCCTCTTAAAAGATGCCTTAATCCATTCCTTGAGGACAGACCTTAGTTGAAATGATAGCAGAATGTGCTTCTCTCTGGCAGCTGGCCTTCTGCTTCTGAGTTGCACATTAATCAGATTAGCCTGTATTCTCTTCAGTGAATTTTGATAATGGCTTCCAGACTCTTTGGCGTTGGAGACGCCTGTTAGGATCTTCAAGTCCCATCATAGAAAATTGAAACACAGAGTTGTTCTGCTGATAGTTTTGGGGATACGTCCATCTTTTTAAGGGATTGCTTTCATCTAATTCTGGCAGGACCTCACCAAAAGATCCAGCCTCATACCTACATCAGACAAAATATCGCCGTTGTTCCTTCTGTACTAAAGTATTGTGTTTTGCTTTGGAAACACCCACTCACTTTGCAATAGCCGTGCAAGATGAATGCAGATTACACTGATCTTATGTGTTACAAAATTGGAGAAAGTATTTAATAAAACCTGTTAATTTTTATACTGACAATAAAAATGTTTCTACAGATATTAATGTTAACAAGACAAAATAAATGTCACGCAACTTATTTTTTT

SEQ ID NO: 20 - protein, 732 aa, Homo sapiens
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 21 - protein, 4255 aa, Homo sapiens
CCCAAGGACCACTCTTCTGCGTTTGGAGTTGCTCCCCGCAACCCCGGGCTCGTCGCTTTCTCCATCCCGACCCACGCGGGGCGCGGGGACAACACAGGTCGCGGAGGAGCGTTGCCATTCAAGTGACTGCAGCAGCAGCGGCAGCGCCTCGGTTCCTGAGCCCACCGCAGGCTGAAGGCATTGCGCGTAGTCCATGCCCGTAGAGGAAGTGTGCAGATGGGATTAACGTCCACATGGAGATATGGAAGAGGACCGGGGATTGGTACCGTAACCATGGTCAGCTGGGGTCGTTTCATCTGCCTGGTCGTGGTCACCATGGCAACCTTGTCCCTGGCCCGGCCCTCCTTCAGTTTAGTTGAGGATACCACATTAGAGCCAGAAGAGCCACCAACCAAATACCAAATCTCTCAACCAGAAGTGTACGTGGCTGCGCCAGGGGAGTCGCTAGAGGTGCGCTGCCTGTTGAAAGATGCCGCCGTGATCAGTTGGACTAAGGATGGGGTGCACTTGGGGCCCAACAATAGGACAGTGCTTATTGGGGAGTACTTGCAGATAAAGGGCGCCACGCCTAGAGACTCCGGCCTCTATGCTTGTACTGCCAGTAGGACTGTAGACAGTGAAACTTGGTACTTCATGGTGAATGTCACAGATGCCATCTCATCCGGAGATGATGAGGATGACACCGATGGTGCGGAAGATTTTGTCAGTGAGAACAGTAACAACAAGAGAGCACCATACTGGACCAACACAGAAAAGATGGAAAAGCGGCTCCATGCTGTGCCTGCGGCCAACACTGTCAAGTTTCGCTGCCCAGCCGGGGGGAACCCAATGCCAACCATGCGGTGGCTGAAAAACGGGAAGGAGTTTAAGCAGGAGCATCGCATTGGAGGCTACAAGGTACGAAACCAGCACTGGAGCCTCATTATGGAAAGTGTGGTCCCATCTGACAAGGGAAATTATACCTGTGTAGTGGAGAATGAATACGGGTCCATCAATCACACGTACCACCTGGATGTTGTGGAGCGATCGCCTCACCGGCCCATCCTCCAAGCCGGACTGCCGGCAAATGCCTCCACAGTGGTCGGAGGAGACGTAGAGTTTGTCTGCAAGGTTTACAGTGATGCCCAGCCCCACATCCAGTGGATCAAGCACGTGGAAAAGAACGGCAGTAAATACGGGCCCGACGGGCTGCCCTACCTCAAGGTTCTCAAGGCCGCCGGTGTTAACACCACGGACAAAGAGATTGAGGTTCTCTATATTCGGAATGTAACTTTTGAGGACGCTGGGGAATATACGTGCTTGGCGGGTAATTCTATTGGGATATCCTTTCACTCTGCATGGTTGACAGTTCTGCCAGCGCCTGGAAGAGAAAAGGAGATTACAGCTTCCCCAGACTACCTGGAGATAGCCATTTACTGCATAGGGGTCTTCTTAATCGCCTGTATGGTGGTAACAGTCATCCTGTGCCGAATGAAGAACACGACCAAGAAGCCAGACTTCAGCAGCCAGCCGGCTGTGCACAAGCTGACCAAACGTATCCCCCTGCGGAGACAGGTAACAGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGGAATACTTGGACCTCAGCCAACCTCTCGAACAGTATTCACCTAGTTACCCTGACACAAGAAGTTCTTGTTCTTCAGGAGATGATTCTGTTTTTTCTCCAGACCCCATGCCTTACGAACCATGCCTTCCTCAGTATCCACACATAAACGGCAGTGTTAAAACATGAATGACTGTGTCTGCCTGTCCCCAAACAGGACAGCACTGGGAACCTAGCTACACTGAGCAGGGAGACCATGCCTCCCAGAGCTTGTTGTCTCCACTTGTATATATGGATCAGAGGAGTAAATAATTGGAAAAGTAATCAGCATATGTGTAAAGATTTATACAGTTGAAAACTTGTAATCTTCCCCAGGAGGAGAAGAAGGTTTCTGGAGCAGTGGACTGCCACAAGCCACCATGTAACCCCTCTCACCTGCCGTGCGTACTGGCTGTGGACCAGTAGGACTCAAGGTGGACGTGCGTTCTGCCTTCCTTGTTAATTTTGTAATAATTGGAGAAGATTTATGTCAGCACACACTTACAGAGCACAAATGCAGTATATAGGTGCTGGATGTATGTAAATATATTCAAATTATGTATAAATATATATTATATATTTACAAGGAGTTATTTTTTGTATTGATTTTAAATGGATGTCCCAATGCACCTAGAAAATTGGTCTCTCTTTTTTTAATAGCTATTTGCTAAATGCTGTTCTTACACATAATTTCTTAATTTTCACCGAGCAGAGGTGGAAAAATACTTTTGCTTTCAGGGAAAATGGTATAACGTTAATTTATTAATAAATTGGTAATATACAAAACAATTAATCATTTATAGTTTTTTTTGTAATTTAAGTGGCATTTCTATGCAGGCAGCACAGCAGACTAGTTAATCTATTGCTTGGACTTAACTAGTTATCAGATCCTTTGAAAAGAGAATATTTACAATATATGACTAATTTGGGGAAAATGAAGTTTTGATTTATTTGTGTTTAAATGCTGCTGTCAGACGATTGTTCTTAGACCTCCTAAATGCCCCATATTAAAAGAACTCATTCATAGGAAGGTGTTTCATTTTGGTGTGCAACCCTGTCATTACGTCAACGCAACGTCTAACTGGACTTCCCAAGATAAATGGTACCAGCGTCCTCTTAAAAGATGCCTTAATCCATTCCTTGAGGACAGACCTTAGTTGAAATGATAGCAGAATGTGCTTCTCTCTGGCAGCTGGCCTTCTGCTTCTGAGTTGCACATTAATCAGATTAGCCTGTATTCTCTTCAGTGAATTTTGATAATGGCTTCCAGACTCTTTGGCGTTGGAGACGCCTGTTAGGATCTTCAAGTCCCATCATAGAAAATTGAAACACAGAGTTGTTCTGCTGATAGTTTTGGGGATACGTCCATCTTTTTAAGGGATTGCTTTCATCTAATTCTGGCAGGACCTCACCAAAAGATCCAGCCTCATACCTACATCAGACAAAATATCGCCGTTGTTCCTTCTGTACTAAAGTATTGTGTTTTGCTTTGGAAACACCCACTCACTTTGCAATAGCCGTGCAAGATGAATGCAGATTACACTGATCTTATGTGTTACAAAATTGGAGAAAGTATTTAATAAAACCTGTTAATTTTTATACTGACAATAAAAATGTTTCTACAGATATTAATGTTAACAAGACAAAATAAATGTCACGCAACTTA

SEQ ID NO: 22 - protein, 821 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 23 - protein, 3990 aa, Homo sapiens
ACAGACTCTCCCGCAGAACTGACCCCAGCAAGAAGCCTTTGGGAGCAGTAGAGATGGAGTTTCACTATGTTGCCCAGGCTAGCCTTGAACTCCTGACCTCAGATGATCTGCCCGCGCAGGCCTCCCGAAGTGCTGGGATTACAGGCATGAGCCACCGCACCTGGCCTGCCAACTCTTGTTAAGATCTCGAAGGAAACATTTTCTTCCCCTGAAGGAAACCCAGCTATGCAGACACCAGCTGATAATCTTGCATTCCTGAAAGATGTTGCACCCCTATGGCAAGTGGCGGCTGCTGAGGCTCTGACGTGACTCCCAGGCATGAACGCTCTCAGCTGTGTTTACCTCAGCTCCTCGGGAGGGAGCCTGGGAGACTGACGCCTGAGTTTTACATCAGTGTCAAAACCCAAGCACAACCTAGGGAGGGACCTCCTGCCTAGTGTGTGTGGGTCAGGAGATAGAAAAGCTCTCACTGAGTAAACTGGACAAGGTCAATATACCTCGCTGATTGAGAAGACTTCACTCTCTCTGCAAAGAGACGTGTGTGTTTTAGAGGAAGTGGGAGCCCCAGCCGATTCTGCAAGACTTCCGAGAGTCAGATATCCAGACAGAAGATGCGGACACCTGGGTGACCAGACAGCGAAGAGGAAAGAACAAAACGAGCATGTGCCAAGCCTGTGAGGGAGAAAGGGCAACAAACCAGTGACCTTCCACAGAAATGTGTTTAAACAAAACAAAACAGCTCTTTGGCGTTGCTAAGAGACTGCCATTTTGGAGGAAAGAGCGATCGCCTCACCGGCCCATCCTCCAAGCCGGACTGCCGGCAAATGCCTCCACAGTGGTCGGAGGAGACGTAGAGTTTGTCTGCAAGGTTTACAGTGATGCCCAGCCCCACATCCAGTGGATCAAGCACGTGGAAAAGAACGGCAGTAAATACGGGCCCGACGGGCTGCCCTACCTCAAGGTTCTCAAGGCCGCCGGTGTTAACACCACGGACAAAGAGATTGAGGTTCTCTATATTCGGAATGTAACTTTTGAGGACGCTGGGGAATATACGTGCTTGGCGGGTAATTCTATTGGGATATCCTTTCACTCTGCATGGTTGACAGTTCTGCCAGCGCCTGGAAGAGAAAAGGAGATTACAGCTTCCCCAGACTACCTGGAGATAGCCATTTACTGCATAGGGGTCTTCTTAATCGCCTGTATGGTGGTAACAGTCATCCTGTGCCGAATGAAGAACACGACCAAGAAGCCAGACTTCAGCAGCCAGCCGGCTGTGCACAAGCTGACCAAACGTATCCCCCTGCGGAGACAGGTAACAGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGGAATACTTGGACCTCAGCCAACCTCTCGAACAGTATTCACCTAGTTACCCTGACACAAGAAGTTCTTGTTCTTCAGGAGATGATTCTGTTTTTTCTCCAGACCCCATGCCTTACGAACCATGCCTTCCTCAGTATCCACACATAAACGGCAGTGTTAAAACATGAATGACTGTGTCTGCCTGTCCCCAAACAGGACAGCACTGGGAACCTAGCTACACTGAGCAGGGAGACCATGCCTCCCAGAGCTTGTTGTCTCCACTTGTATATATGGATCAGAGGAGTAAATAATTGGAAAAGTAATCAGCATATGTGTAAAGATTTATACAGTTGAAAACTTGTAATCTTCCCCAGGAGGAGAAGAAGGTTTCTGGAGCAGTGGACTGCCACAAGCCACCATGTAACCCCTCTCACCTGCCGTGCGTACTGGCTGTGGACCAGTAGGACTCAAGGTGGACGTGCGTTCTGCCTTCCTTGTTAATTTTGTAATAATTGGAGAAGATTTATGTCAGCACACACTTACAGAGCACAAATGCAGTATATAGGTGCTGGATGTATGTAAATATATTCAAATTATGTATAAATATATATTATATATTTACAAGGAGTTATTTTTTGTATTGATTTTAAATGGATGTCCCAATGCACCTAGAAAATTGGTCTCTCTTTTTTTAATAGCTATTTGCTAAATGCTGTTCTTACACATAATTTCTTAATTTTCACCGAGCAGAGGTGGAAAAATACTTTTGCTTTCAGGGAAAATGGTATAACGTTAATTTATTAATAAATTGGTAATATACAAAACAATTAATCATTTATAGTTTTTTTTGTAATTTAAGTGGCATTTCTATGCAGGCAGCACAGCAGACTAGTTAATCTATTGCTTGGACTTAACTAGTTATCAGATCCTTTGAAAAGAGAATATTTACAATATATGACTAATTTGGGGAAAATGAAGTTTTGATTTATTTGTGTTTAAATGCTGCTGTCAGACGATTGTTCTTAGACCTCCTAAATGCCCCATATTAAAAGAACTCATTCATAGGAAGGTGTTTCATTTTGGTGTGCAACCCTGTCATTACGTCAACGCAACGTCTAACTGGACTTCCCAAGATAAATGGTACCAGCGTCCTCTTAAAAGATGCCTTAATCCATTCCTTGAGGACAGACCTTAGTTGAAATGATAGCAGAATGTGCTTCTCTCTGGCAGCTGGCCTTCTGCTTCTGAGTTGCACATTAATCAGATTAGCCTGTATTCTCTTCAGTGAATTTTGATAATGGCTTCCAGACTCTTTGGCGTTGGAGACGCCTGTTAGGATCTTCAAGTCCCATCATAGAAAATTGAAACACAGAGTTGTTCTGCTGATAGTTTTGGGGATACGTCCATCTTTTTAAGGGATTGCTTTCATCTAATTCTGGCAGGACCTCACCAAAAGATCCAGCCTCATACCTACATCAGACAAAATATCGCCGTTGTTCCTTCTGTACTAAAGTATTGTGTTTTGCTTTGGAAACACCCACTCACTTTGCAATAGCCGTGCAAGATGAATGCAGATTACACTGATCTTATGTGTTACAAAATTGGAGAAAGTATTTAATAAAACCTGTTAATTTTTATACTGACAATAAAAATGTTTCTACAGATATTAATGTTAACAAGA

SEQ ID NO: 24 - protein, 593 aa, Homo sapiens
MCLNKTKQLFGVAKRLPFWRKERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 25 - protein, 3803 aa, Homo sapiens
TGACTGCAGCAGCAGCGGCAGCGCCTCGGTTCCTGAGCCCACCGCAGGCTGAAGGCATTGCGCGTAGTCCATGCCCGTAGAGGAAGTGTGCAGATGGGATTAACGTCCACATGGAGATATGGAAGAGGACCGGGGATTGGTACCGTAACCATGGTCAGCTGGGGTCGTTTCATCTGCCTGGTCGTGGTCACCATGGCAACCTTGTCCCTGGCCCGGCCCTCCTTCAGTTTAGTTGAGGATACCACATTAGAGCCAGAAGAGCCACCAACCAAATACCAAATCTCTCAACCAGAAGTGTACGTGGCTGCGCCAGGGGAGTCGCTAGAGGTGCGCTGCCTGTTGAAAGATGCCGCCGTGATCAGTTGGACTAAGGATGGGGTGCACTTGGGGCCCAACAATAGGACAGTGCTTATTGGGGAGTACTTGCAGATAAAGGGCGCCACGCCTAGAGACTCCGGCCTCTATGCTTGTACTGCCAGTAGGACTGTAGACAGTGAAACTTGGTACTTCATGGTGAATGTCACAGATGCCATCTCATCCGGAGATGATGAGGATGACACCGATGGTGCGGAAGATTTTGTCAGTGAGAACAGTAACAACAAGAGAGCACCATACTGGACCAACACAGAAAAGATGGAAAAGCGGCTCCATGCTGTGCCTGCGGCCAACACTGTCAAGTTTCGCTGCCCAGCCGGGGGGAACCCAATGCCAACCATGCGGTGGCTGAAAAACGGGAAGGAGTTTAAGCAGGAGCATCGCATTGGAGGCTACAAGGTACGAAACCAGCACTGGAGCCTCATTATGGAAAGTGTGGTCCCATCTGACAAGGGAAATTATACCTGTGTAGTGGAGAATGAATACGGGTCCATCAATCACACGTACCACCTGGATGTTGTGGCGCCTGGAAGAGAAAAGGAGATTACAGCTTCCCCAGACTACCTGGAGATAGCCATTTACTGCATAGGGGTCTTCTTAATCGCCTGTATGGTGGTAACAGTCATCCTGTGCCGAATGAAGAACACGACCAAGAAGCCAGACTTCAGCAGCCAGCCGGCTGTGCACAAGCTGACCAAACGTATCCCCCTGCGGAGACAGGTAACAGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGGAATACTTGGACCTCAGCCAACCTCTCGAACAGTATTCACCTAGTTACCCTGACACAAGAAGTTCTTGTTCTTCAGGAGATGATTCTGTTTTTTCTCCAGACCCCATGCCTTACGAACCATGCCTTCCTCAGTATCCACACATAAACGGCAGTGTTAAAACATGAATGACTGTGTCTGCCTGTCCCCAAACAGGACAGCACTGGGAACCTAGCTACACTGAGCAGGGAGACCATGCCTCCCAGAGCTTGTTGTCTCCACTTGTATATATGGATCAGAGGAGTAAATAATTGGAAAAGTAATCAGCATATGTGTAAAGATTTATACAGTTGAAAACTTGTAATCTTCCCCAGGAGGAGAAGAAGGTTTCTGGAGCAGTGGACTGCCACAAGCCACCATGTAACCCCTCTCACCTGCCGTGCGTACTGGCTGTGGACCAGTAGGACTCAAGGTGGACGTGCGTTCTGCCTTCCTTGTTAATTTTGTAATAATTGGAGAAGATTTATGTCAGCACACACTTACAGAGCACAAATGCAGTATATAGGTGCTGGATGTATGTAAATATATTCAAATTATGTATAAATATATATTATATATTTACAAGGAGTTATTTTTTGTATTGATTTTAAATGGATGTCCCAATGCACCTAGAAAATTGGTCTCTCTTTTTTTAATAGCTATTTGCTAAATGCTGTTCTTACACATAATTTCTTAATTTTCACCGAGCAGAGGTGGAAAAATACTTTTGCTTTCAGGGAAAATGGTATAACGTTAATTTATTAATAAATTGGTAATATACAAAACAATTAATCATTTATAGTTTTTTTTGTAATTTAAGTGGCATTTCTATGCAGGCAGCACAGCAGACTAGTTAATCTATTGCTTGGACTTAACTAGTTATCAGATCCTTTGAAAAGAGAATATTTACAATATATGACTAATTTGGGGAAAATGAAGTTTTGATTTATTTGTGTTTAAATGCTGCTGTCAGACGATTGTTCTTAGACCTCCTAAATGCCCCATATTAAAAGAACTCATTCATAGGAAGGTGTTTCATTTTGGTGTGCAACCCTGTCATTACGTCAACGCAACGTCTAACTGGACTTCCCAAGATAAATGGTACCAGCGTCCTCTTAAAAGATGCCTTAATCCATTCCTTGAGGACAGACCTTAGTTGAAATGATAGCAGAATGTGCTTCTCTCTGGCAGCTGGCCTTCTGCTTCTGAGTTGCACATTAATCAGATTAGCCTGTATTCTCTTCAGTGAATTTTGATAATGGCTTCCAGACTCTTTGGCGTTGGAGACGCCTGTTAGGATCTTCAAGTCCCATCATAGAAAATTGAAACACAGAGTTGTTCTGCTGATAGTTTTGGGGATACGTCCATCTTTTTAAGGGATTGCTTTCATCTAATTCTGGCAGGACCTCACCAAAAGATCCAGCCTCATACCTACATCAGACAAAATATCGCCGTTGTTCCTTCTGTACTAAAGTATTGTGTTTTGCTTTGGAAACACCCACTCACTTTGCAATAGCCGTGCAAGATGAATGCAGATTACACTGATCTTATGTGTTACAAAATTGGAGAAAGTATTTAATAAAACCTGTTAATTTTTATACTGACAATAAAAATGTTTCTACAGATATTAATGTTAACAAGACAAAATAAATGTCACGCAACTTATTTTTTT

SEQ ID NO: 26 - protein, 709 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 27 - protein, 3690 aa, Homo sapiens
AATTTGTTGAGGAATTTCCCCCTAGCCTTGACCCCTTGACAGCTCCCGCTCCTACTCAGTGCTGGGGAGAAGTAGGGAGGCCTTAAGCGAAGAGATGGGTCTGCACTTTGGAGGAGCCGGACACTGTTGACTTTCCTGATGTGAAATCTACCCAGGAACAAAACACCAGTGACTGCAGCAGCAGCGGCAGCGCCTCGGTTCCTGAGCCCACCGCAGGCTGAAGGCATTGCGCGTAGTCCATGCCCGTAGAGGAAGTGTGCAGATGGGATTAACGTCCACATGGAGATATGGAAGAGGACCGGGGATTGGTACCGTAACCATGGTCAGCTGGGGTCGTTTCATCTGCCTGGTCGTGGTCACCATGGCAACCTTGTCCCTGGCCCGGCCCTCCTTCAGTTTAGTTGAGGATACCACATTAGAGCCAGAAGATGCCATCTCATCCGGAGATGATGAGGATGACACCGATGGTGCGGAAGATTTTGTCAGTGAGAACAGTAACAACAAGAGAGCACCATACTGGACCAACACAGAAAAGATGGAAAAGCGGCTCCATGCTGTGCCTGCGGCCAACACTGTCAAGTTTCGCTGCCCAGCCGGGGGGAACCCAATGCCAACCATGCGGTGGCTGAAAAACGGGAAGGAGTTTAAGCAGGAGCATCGCATTGGAGGCTACAAGGTACGAAACCAGCACTGGAGCCTCATTATGGAAAGTGTGGTCCCATCTGACAAGGGAAATTATACCTGTGTAGTGGAGAATGAATACGGGTCCATCAATCACACGTACCACCTGGATGTTGTGGAGCGATCGCCTCACCGGCCCATCCTCCAAGCCGGACTGCCGGCAAATGCCTCCACAGTGGTCGGAGGAGACGTAGAGTTTGTCTGCAAGGTTTACAGTGATGCCCAGCCCCACATCCAGTGGATCAAGCACGTGGAAAAGAACGGCAGTAAATACGGGCCCGACGGGCTGCCCTACCTCAAGGTTCTCAAGGCCGCCGGTGTTAACACCACGGACAAAGAGATTGAGGTTCTCTATATTCGGAATGTAACTTTTGAGGACGCTGGGGAATATACGTGCTTGGCGGGTAATTCTATTGGGATATCCTTTCACTCTGCATGGTTGACAGTTCTGCCAGCGCCTGGAAGAGAAAAGGAGATTACAGCTTCCCCAGACTACCTGGAGATAGCCATTTACTGCATAGGGGTCTTCTTAATCGCCTGTATGGTGGTAACAGTCATCCTGTGCCGAATGAAGAACACGACCAAGAAGCCAGACTTCAGCAGCCAGCCGGCTGTGCACAAGCTGACCAAACGTATCCCCCTGCGGAGACAGGTAACAGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGGAGGAGAAGAAGGTTTCTGGAGCAGTGGACTGCCACAAGCCACCATGTAACCCCTCTCACCTGCCGTGCGTACTGGCTGTGGACCAGTAGGACTCAAGGTGGACGTGCGTTCTGCCTTCCTTGTTAATTTTGTAATAATTGGAGAAGATTTATGTCAGCACACACTTACAGAGCACAAATGCAGTATATAGGTGCTGGATGTATGTAAATATATTCAAATTATGTATAAATATATATTATATATTTACAAGGAGTTATTTTTTGTATTGATTTTAAATGGATGTCCCAATGCACCTAGAAAATTGGTCTCTCTTTTTTTAATAGCTATTTGCTAAATGCTGTTCTTACACATAATTTCTTAATTTTCACCGAGCAGAGGTGGAAAAATACTTTTGCTTTCAGGGAAAATGGTATAACGTTAATTTATTAATAAATTGGTAATATACAAAACAATTAATCATTTATAGTTTTTTTTGTAATTTAAGTGGCATTTCTATGCAGGCAGCACAGCAGACTAGTTAATCTATTGCTTGGACTTAACTAGTTATCAGATCCTTTGAAAAGAGAATATTTACAATATATGACTAATTTGGGGAAAATGAAGTTTTGATTTATTTGTGTTTAAATGCTGCTGTCAGACGATTGTTCTTAGACCTCCTAAATGCCCCATATTAAAAGAACTCATTCATAGGAAGGTGTTTCATTTTGGTGTGCAACCCTGTCATTACGTCAACGCAACGTCTAACTGGACTTCCCAAGATAAATGGTACCAGCGTCCTCTTAAAAGATGCCTTAATCCATTCCTTGAGGACAGACCTTAGTTGAAATGATAGCAGAATGTGCTTCTCTCTGGCAGCTGGCCTTCTGCTTCTGAGTTGCACATTAATCAGATTAGCCTGTATTCTCTTCAGTGAATTTTGATAATGGCTTCCAGACTCTTTGGCGTTGGAGACGCCTGTTAGGATCTTCAAGTCCCATCATAGAAAATTGAAACACAGAGTTGTTCTGCTGATAGTTTTGGGGATACGTCCATCTTTTTAAGGGATTGCTTTCATCTAATTCTGGCAGGACCTCACCAAAAGATCCAGCCTCATACCTACATCAGACAAAATATCGCCGTTGTTCCTTCTGTACTAAAGTATTGTGTTTTGCTTTGGAAACACCCACTCACTTTGCAATAGCCGTGCAAGATGAATGCAGATTACACTGATCTTATGTGTTACAAAATTGGAGAAAGTATTTAATAAAACCTGTTAATTTTTATACTGACAATAAAAATGTTTCTACAGATATTAATGTTAACAAGACAAAATAAATGTCACGCAACTTATTTTTTT

SEQ ID NO: 28 - protein, 707 aa, Homo sapiens
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEEKKVSGAVDCHKPPCNPSHLPCVLAVDQ

SEQ ID NO: 29 - protein, 3547 aa, Homo sapiens
GGCGGCGGCTGGAGGAGAGCGCGGTGGAGAGCCGAGCGGGCGGGCGGCGGGTGCGGAGCGGGCGAGGGAGCGCGCGCGGCCGCCACAAAGCTCGGGCGCCGCGGGGCTGCATGCGGCGTACCTGGCCCGGCGCGGCGACTGCTCTCCGGGCTGGCGGGGGCCGGCCGCGAGCCCCGGGGGCCCCGAGGCCGCAGCTTGCCTGCGCGCTCTGAGCCTTCGCAACTCGCGAGCAAAGTTTGGTGGAGGCAACGCCAAGCCTGAGTCCTTTCTTCCTCTCGTTCCCCAAATCCGAGGGCAGCCCGCGGGCGTCATGCCCGCGCTCCTCCGCAGCCTGGGGTACGCGTGAAGCCCGGGAGGCTTGGCGCCGGCGAAGACCCAAGGACCACTCTTCTGCGTTTGGAGTTGCTCCCCGCAACCCCGGGCTCGTCGCTTTCTCCATCCCGACCCACGCGGGGCGCGGGGACAACACAGGTCGCGGAGGAGCGTTGCCATTCAAGTGACTGCAGCAGCAGCGGCAGCGCCTCGGTTCCTGAGCCCACCGCAGGCTGAAGGCATTGCGCGTAGTCCATGCCCGTAGAGGAAGTGTGCAGATGGGATTAACGTCCACATGGAGATATGGAAGAGGACCGGGGATTGGTACCGTAACCATGGTCAGCTGGGGTCGTTTCATCTGCCTGGTCGTGGTCACCATGGCAACCTTGTCCCTGGCCCGGCCCTCCTTCAGTTTAGTTGAGGATACCACATTAGAGCCAGAAGGAGCACCATACTGGACCAACACAGAAAAGATGGAAAAGCGGCTCCATGCTGTGCCTGCGGCCAACACTGTCAAGTTTCGCTGCCCAGCCGGGGGGAACCCAATGCCAACCATGCGGTGGCTGAAAAACGGGAAGGAGTTTAAGCAGGAGCATCGCATTGGAGGCTACAAGGTACGAAACCAGCACTGGAGCCTCATTATGGAAAGTGTGGTCCCATCTGACAAGGGAAATTATACCTGTGTAGTGGAGAATGAATACGGGTCCATCAATCACACGTACCACCTGGATGTTGTGGAGCGATCGCCTCACCGGCCCATCCTCCAAGCCGGACTGCCGGCAAATGCCTCCACAGTGGTCGGAGGAGACGTAGAGTTTGTCTGCAAGGTTTACAGTGATGCCCAGCCCCACATCCAGTGGATCAAGCACGTGGAAAAGAACGGCAGTAAATACGGGCCCGACGGGCTGCCCTACCTCAAGGTTCTCAAGGCCGCCGGTGTTAACACCACGGACAAAGAGATTGAGGTTCTCTATATTCGGAATGTAACTTTTGAGGACGCTGGGGAATATACGTGCTTGGCGGGTAATTCTATTGGGATATCCTTTCACTCTGCATGGTTGACAGTTCTGCCAGCGCCTGGAAGAGAAAAGGAGATTACAGCTTCCCCAGACTACCTGGAGATAGCCATTTACTGCATAGGGGTCTTCTTAATCGCCTGTATGGTGGTAACAGTCATCCTGTGCCGAATGAAGAACACGACCAAGAAGCCAGACTTCAGCAGCCAGCCGGCTGTGCACAAGCTGACCAAACGTATCCCCCTGCGGAGACAGGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGGAATACTTGGACCTCAGCCAACCTCTCGAACAGTATTCACCTAGTTACCCTGACACAAGAAGTTCTTGTTCTTCAGGAGATGATTCTGTTTTTTCTCCAGACCCCATGCCTTACGAACCATGCCTTCCTCAGTATCCACACATAAACGGCAGTGTTAAAACATGAATGACTGTGTCTGCCTGTCCCCAAACAGGACAGCACTGGGAACCTAGCTACACTGAGCAGGGAGACCATGCCTCCCAGAGCTTGTTGTCTCCACTTGTATATATGGATCAGAGGAGTAAATAATTGGAAAAGTAATCAGCATATGTGTAAAGATTTATACAGTTGAAAACTTGTAATCTTCCCCAGGAGGAGAAGAAGGTTTCTGGAGCAGTGGACTGCCACAAGCCACCATGTAACCCCTCTCACCTGCCGTGCGTACTGGCTGTGGACCAGTAGGACTCAAGGTGGACGTGCGTTCTGCCTTCCTTGTTAATTTTGTAATAATTGGAGAAGATTTATGTCAGCACACACTTACAGAGCACAAATGCAGTATATAGGTGCTGGATGTATGTAAATATATTCAAATTATGTATAAATATATATTATATATTTACAAGGAGTTATTTTTTGTATTGATTTTAAATGGATGTCCCAATGCACCTAGAAAATTGGTCTCTCTTTTTTTAATAGCTATTTGCTAAATGCTGTTCTTACACATAATTTCTTAATTTTCACCGAGCAGAGGTGGAAAAATACTTTTGCTTTCAGGGAAAATGGTATAACGTTAATTTATTAATAAATTGGTAATATACAAAACAATTAATCATTTATAGTTTTTTTTGTAATTTAAGTGGCATTTCTATGCAGGCAGCACAGCAGACTAGTTAATCTATTGCTTGGACTTAACTAGTTATCAGATCCTTTGAAAAGAGAATATTTACAATATATGACTAATTTGGGGAAAA

SEQ ID NO: 30 - protein, 704 aa, Homo sapiens
MVSWGRFICLVVVTMATLSLARPSFSLVEDTTLEPEGAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 31 - protein, 3244 aa, Homo sapiens
CCGGCCGCGAGCCCCGGGGGCCCCGAGGCCGCAGCTTGCCTGCGCGCTCTGAGCCTTCGCAACTCGCGAGCAAAGTTTGGTGGAGGCAACGCCAAGCCTGAGTCCTTTCTTCCTCTCGTTCCCCAAATCCGAGGGCAGCCCGCGGGCGTCATGCCCGCGCTCCTCCGCAGCCTGGGGTACGCGTGAAGCCCGGGAGGCTTGGCGCCGGCGAAGACCCAAGGACCACTCTTCTGCGTTTGGAGTTGCTCCCCGCAACCCCGGGCTCGTCGCTTTCTCCATCCCGACCCACGCGGGGCGCGGGGACAACACAGGTCGCGGAGGAGCGTTGCCATTCAAGTGACTGCAGCAGCAGCGGCAGCGCCTCGGTTCCTGAGCCCACCGCAGGCTGAAGGCATTGCGCGTAGTCCATGCCCGTAGAGGAAGTGTGCAGATGGGATTAACGTCCACATGGAGATATGGAAGAGGACCGGGGATTGGTACCGTAACCATGGTCAGCTGGGGTCGTTTCATCTGCCTGGTCGTGGTCACCATGGCAACCTTGTCCCTGGCCCGGCCCTCCTTCAGTTTAGTTGAGGATACCACATTAGAGCCAGAAGAGCCACCAACCAAATACCAAATCTCTCAACCAGAAGTGTACGTGGCTGCGCCAGGGGAGTCGCTAGAGGTGCGCTGCCTGTTGAAAGATGCCGCCGTGATCAGTTGGACTAAGGATGGGGTGCACTTGGGGCCCAACAATAGGACAGTGCTTATTGGGGAGTACTTGCAGATAAAGGGCGCCACGCCTAGAGACTCCGGCCTCTATGCTTGTACTGCCAGTAGGACTGTAGACAGTGAAACTTGGTACTTCATGGTGAATGTCACAGATGCCATCTCATCCGGAGATGATGAGGATGACACCGATGGTGCGGAAGATTTTGTCAGTGAGAACAGTAACAACAAGAGAGCACCATACTGGACCAACACAGAAAAGATGGAAAAGCGGCTCCATGCTGTGCCTGCGGCCAACACTGTCAAGTTTCGCTGCCCAGCCGGGGGGAACCCAATGCCAACCATGCGGTGGCTGAAAAACGGGAAGGAGTTTAAGCAGGAGCATCGCATTGGAGGCTACAAGGTACGAAACCAGCACTGGAGCCTCATTATGGAAAGTGTGGTCCCATCTGACAAGGGAAATTATACCTGTGTAGTGGAGAATGAATACGGGTCCATCAATCACACGTACCACCTGGATGTTGTGGAGCGATCGCCTCACCGGCCCATCCTCCAAGCCGGACTGCCGGCAAATGCCTCCACAGTGGTCGGAGGAGACGTAGAGTTTGTCTGCAAGGTTTACAGTGATGCCCAGCCCCACATCCAGTGGATCAAGCACGTGGAAAAGAACGGCAGTAAATACGGGCCCGACGGGCTGCCCTACCTCAAGGTTCTCAAGGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGGAATACTTGGACCTCAGCCAACCTCTCGAACAGTATTCACCTAGTTACCCTGACACAAGAAGTTCTTGTTCTTCAGGAGATGATTCTGTTTTTTCTCCAGACCCCATGCCTTACGAACCATGCCTTCCTCAGTATCCACACATAAACGGCAGTGTTAAAACATGAATGACTGTGTCTGCCTGTCCCCAAACAGGACAGCACTGGGAACCTAGCTACACTGAGCAGGGAGACCATGCCTCCCAGAGCTTGTTGTCTCCACTTGTATATATGGATCAGAGGAGTAAATAATTGGAAAAGTAATCAGCATATGTGTAAAGATTTATACAGTTGAAAACTTGTAATCTTCCCCAGGAGGAGAAGAAGGTTTCTGGAGCAGTGGACTGCCACAAGCCACCATGTAACCCCTCTCACCTGCCGTGCGTACTGGCTGTGGACCAGTAGGACTCAAGGTGGACGTGCGTTCTGCCTTCCTTGTTAATTTTGTAATAATTGGAGAAGATTTATGTCAGCACACACTTACAGAGCACAAATGCAGTATATAGGTGCTGGATGTATGTAAATATATTCAAATTATGTATAAATATATATTATATATTTACAAGGAGTTATTTTTTGTATTGATTTTAAATGGATGTCCCAATGCACCTAGAAAATTGGTCTCTCTTTTTTTAATAGCTATTTGCTAAATGCTGTTCTTACACATAATTTCTTAATTTTCACCGAGCAGAGGTGGAAAAATACTTTTGCTTTCAGGGAAAATGGTATAACGTTAATTTATTAATAAATTGGTAATATACAAAACAA

SEQ ID NO: 32 - protein, 705 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 33 - protein, 3061 aa, Homo sapiens
GAGCGGGCGAGGGAGCGCGCGCGGCCGCCACAAAGCTCGGGCGCCGCGGGGCTGCATGCGGCGTACCTGGCCCGGCGCGGCGACTGCTCTCCGGGCTGGCGGGGGCCGGCCGCGAGCCCCGGGGGCCCCGAGGCCGCAGCTTGCCTGCGCGCTCTGAGCCTTCGCAACTCGCGAGCAAAGTTTGGTGGAGGCAACGCCAAGCCTGAGTCCTTTCTTCCTCTCGTTCCCCAAATCCGAGGGCAGCCCGCGGGCGTCATGCCCGCGCTCCTCCGCAGCCTGGGGTACGCGTGAAGCCCGGGAGGCTTGGCGCCGGCGAAGACCCAAGGACCACTCTTCTGCGTTTGGAGTTGCTCCCCGCAACCCCGGGCTCGTCGCTTTCTCCATCCCGACCCACGCGGGGCGCGGGGACAACACAGGTCGCGGAGGAGCGTTGCCATTCAAGTGACTGCAGCAGCAGCGGCAGCGCCTCGGTTCCTGAGCCCACCGCAGGCTGAAGGCATTGCGCGTAGTCCATGCCCGTAGAGGAAGTGTGCAGATGGGATTAACGTCCACATGGAGATATGGAAGAGGACCGGGGATTGGTACCGTAACCATGGTCAGCTGGGGTCGTTTCATCTGCCTGGTCGTGGTCACCATGGCAACCTTGTCCCTGGCCCGGCCCTCCTTCAGTTTAGTTGAGGATACCACATTAGAGCCAGAAGAGCCACCAACCAAATACCAAATCTCTCAACCAGAAGTGTACGTGGCTGCGCCAGGGGAGTCGCTAGAGGTGCGCTGCCTGTTGAAAGATGCCGCCGTGATCAGTTGGACTAAGGATGGGGTGCACTTGGGGCCCAACAATAGGACAGTGCTTATTGGGGAGTACTTGCAGATAAAGGGCGCCACGCCTAGAGACTCCGGCCTCTATGCTTGTACTGCCAGTAGGACTGTAGACAGTGAAACTTGGTACTTCATGGTGAATGTCACAGATGCCATCTCATCCGGAGATGATGAGGATGACACCGATGGTGCGGAAGATTTTGTCAGTGAGAACAGTAACAACAAGAGAGCACCATACTGGACCAACACAGAAAAGATGGAAAAGCGGCTCCATGCTGTGCCTGCGGCCAACACTGTCAAGTTTCGCTGCCCAGCCGGGGGGAACCCAATGCCAACCATGCGGTGGCTGAAAAACGGGAAGGAGTTTAAGCAGGAGCATCGCATTGGAGGCTACAAGGTACGAAACCAGCACTGGAGCCTCATTATGGAAAGTGTGGTCCCATCTGACAAGGGAAATTATACCTGTGTAGTGGAGAATGAATACGGGTCCATCAATCACACGTACCACCTGGATGTTGTGGAGCGATCGCCTCACCGGCCCATCCTCCAAGCCGGACTGCCGGCAAATGCCTCCACAGTGGTCGGAGGAGACGTAGAGTTTGTCTGCAAGGTTTACAGTGATGCCCAGCCCCACATCCAGTGGATCAAGCACGTGGAAAAGAACGGCAGTAAATACGGGCCCGACGGGCTGCCCTACCTCAAGGTTCTCAAGCACTCGGGGATAAATAGTTCCAATGCAGAAGTGCTGGCTCTGTTCAATGTGACCGAGGCGGATGCTGGGGAATATATATGTAAGGTCTCCAATTATATAGGGCAGGCCAACCAGTCTGCCTGGCTCACTGTCCTGCCAAAACAGCAAGCGCCTGGAAGAGAAAAGGAGATTACAGCTTCCCCAGACTACCTGGAGATAGCCATTTACTGCATAGGGGTCTTCTTAATCGCCTGTATGGTGGTAACAGTCATCCTGTGCCGAATGAAGAACACGACCAAGAAGCCAGACTTCAGCAGCCAGCCGGCTGTGCACAAGCTGACCAAACGTATCCCCCTGCGGAGACAGGTAACAGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGGAATACTTGGACCTCAGCCAACCTCTCGAACAGTATTCACCTAGTTACCCTGACACAAGAAGTTCTTGTTCTTCAGGAGATGATTCTGTTTTTTCTCCAGACCCCATGCCTTACGAACCATGCCTTCCTCAGTATCCACACATAAACGGCAGTGTTAAAACATGA

SEQ ID NO: 34 - protein, 822 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 35 - protein, 3001 aa, Homo sapiens
GAGAGCCGAGCGGGCGGGCGGCGGGTGCGGAGCGGGCGAGGGAGCGCGCGCGGCCGCCACAAAGCTCGGGCGCCGCGGGGCTGCATGCGGCGTACCTGGCCCGGCGCGGCGACTGCTCTCCGGGCTGGCGGGGGCCGGCCGCGAGCCCCGGGGGCCCCGAGGCCGCAGCTTGCCTGCGCGCTCTGAGCCTTCGCAACTCGCGAGCAAAGTTTGGTGGAGGCAACGCCAAGCCTGAGTCCTTTCTTCCTCTCGTTCCCCAAATCCGAGGGCAGCCCGCGGGCGTCATGCCCGCGCTCCTCCGCAGCCTGGGGTACGCGTGAAGCCCGGGAGGCTTGGCGCCGGCGAAGACCCAAGGACCACTCTTCTGCGTTTGGAGTTGCTCCCCGCAACCCCGGGCTCGTCGCTTTCTCCATCCCGACCCACGCGGGGCGCGGGGACAACACAGGTCGCGGAGGAGCGTTGCCATTCAAGTGACTGCAGCAGCAGCGGCAGCGCCTCGGTTCCTGAGCCCACCGCAGGCTGAAGGCATTGCGCGTAGTCCATGCCCGTAGAGGAAGTGTGCAGATGGGATTAACGTCCACATGGAGATATGGAAGAGGACCGGGGATTGGTACCGTAACCATGGTCAGCTGGGGTCGTTTCATCTGCCTGGTCGTGGTCACCATGGCAACCTTGTCCCTGGCCCGGCCCTCCTTCAGTTTAGTTGAGGATACCACATTAGAGCCAGAAGATGCCATCTCATCCGGAGATGATGAGGATGACACCGATGGTGCGGAAGATTTTGTCAGTGAGAACAGTAACAACAAGAGAGCACCATACTGGACCAACACAGAAAAGATGGAAAAGCGGCTCCATGCTGTGCCTGCGGCCAACACTGTCAAGTTTCGCTGCCCAGCCGGGGGGAACCCAATGCCAACCATGCGGTGGCTGAAAAACGGGAAGGAGTTTAAGCAGGAGCATCGCATTGGAGGCTACAAGGTACGAAACCAGCACTGGAGCCTCATTATGGAAAGTGTGGTCCCATCTGACAAGGGAAATTATACCTGTGTAGTGGAGAATGAATACGGGTCCATCAATCACACGTACCACCTGGATGTTGTGGAGCGATCGCCTCACCGGCCCATCCTCCAAGCCGGACTGCCGGCAAATGCCTCCACAGTGGTCGGAGGAGACGTAGAGTTTGTCTGCAAGGTTTACAGTGATGCCCAGCCCCACATCCAGTGGATCAAGCACGTGGAAAAGAACGGCAGTAAATACGGGCCCGACGGGCTGCCCTACCTCAAGGTTCTCAAGCACTCGGGGATAAATAGTTCCAATGCAGAAGTGCTGGCTCTGTTCAATGTGACCGAGGCGGATGCTGGGGAATATATATGTAAGGTCTCCAATTATATAGGGCAGGCCAACCAGTCTGCCTGGCTCACTGTCCTGCCAAAACAGCAAGCGCCTGGAAGAGAAAAGGAGATTACAGCTTCCCCAGACTACCTGGAGATAGCCATTTACTGCATAGGGGTCTTCTTAATCGCCTGTATGGTGGTAACAGTCATCCTGTGCCGAATGAAGAACACGACCAAGAAGCCAGACTTCAGCAGCCAGCCGGCTGTGCACAAGCTGACCAAACGTATCCCCCTGCGGAGACAGGTAACAGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGATCTGAAAGTTTATGGCTTCATTGAGAAACTGGGAAAAGTTGGTCAGGCGCAGTGGCTCATGCCTGTAATCCCAGCACTTTGGGAGGCCGAGGCAGGCGGATCATGAGGTCAGGAGTTCCAGACCAGCCTGGCCAACATGGTGAAACCCTGTCTCTACTAAAGATACAAAAAATTAGCCGGGCGTGTTGGTGTGCACCTGTAATCCCAGCTACTCCGGGAGGCTGAGGCAGGAGAGTCACTTGAACCGGGGAGGCGGAGGTTGCAGTGAGCCGAGATCATGCCATTGCATTCCAGCCTTGGCGACAGAGCGAGACTCCGTCTCAAAAAAAAAAAAAATAAAAA

SEQ ID NO: 36 - protein, 680 aa, Homo sapiens
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEI

SEQ ID NO: 37 - protein, 2650 aa, Homo sapiens
GGACCGGGGATTGGTACCGTAACCATGGTCAGCTGGGGTCGTTTCATCTGCCTGGTCGTGGTCACCATGGCAACCTTGTCCCTGGCCCGGCCCTCCTTCAGTTTAGTTGAGGATACCACATTAGAGCCAGAAGAGCCACCAACCAAATACCAAATCTCTCAACCAGAAGTGTACGTGGCTGCGCCAGGGGAGTCGCTAGAGGTGCGCTGCCTGTTGAAAGATGCCGCCGTGATCAGTTGGACTAAGGATGGGGTGCACTTGGGGCCCAACAATAGGACAGTGCTTATTGGGGAGTACTTGCAGATAAAGGGCGCCACGCCTAGAGACTCCGGCCTCTATGCTTGTACTGCCAGTAGGACTGTAGACAGTGAAACTTGGTACTTCATGGTGAATGTCACAGATGCCATCTCATCCGGAGATGATGAGGATGACACCGATGGTGCGGAAGATTTTGTCAGTGAGAACAGTAACAACAAGAGAGCACCATACTGGACCAACACAGAAAAGATGGAAAAGCGGCTCCATGCTGTGCCTGCGGCCAACACTGTCAAGTTTCGCTGCCCAGCCGGGGGGAACCCAATGCCAACCATGCGGTGGCTGAAAAACGGGAAGGAGTTTAAGCAGGAGCATCGCATTGGAGGCTACAAGGTACGAAACCAGCACTGGAGCCTCATTATGGAAAGTGTGGTCCCATCTGACAAGGGAAATTATACCTGTGTAGTGGAGAATGAATACGGGTCCATCAATCACACGTACCACCTGGATGTTGTGGAGCGATCGCCTCACCGGCCCATCCTCCAAGCCGGACTGCCGGCAAATGCCTCCACAGTGGTCGGAGGAGACGTAGAGTTTGTCTGCAAGGTTTACAGTGATGCCCAGCCCCACATCCAGTGGATCAAGCACGTGGAAAAGAACGGCAGTAAATACGGGCCCGACGGGCTGCCCTACCTCAAGGTTCTCAAGCACTCGGGGATAAATAGTTCCAATGCAGAAGTGCTGGCTCTGTTCAATGTGACCGAGGCGGATGCTGGGGAATATATATGTAAGGTCTCCAATTATATAGGGCAGGCCAACCAGTCTGCCTGGCTCACTGTCCTGCCAAAACAGCAAGCGCCTGGAAGAGAAAAGGAGATTACAGCTTCCCCAGACTACCTGGAGATAGCCATTTACTGCATAGGGGTCTTCTTAATCGCCTGTATGGTGGTAACAGTCATCCTGTGCCGAATGAAGAACACGACCAAGAAGCCAGACTTCAGCAGCCAGCCGGCTGTGCACAAGCTGACCAAACGTATCCCCCTGCGGAGACAGGTAACAGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGATCTGAAAGTTTATGGCTTCATTGAGAAACTGGGAAAAGTTGGTCAGGCGCAGTGGCTCATGCCTGTAATCCCAGCACTTTGGGAGGCCGAGGCAGGCGGATCATGAGGTCAGGAGTTCCAGACCAGCCTGGCCAACATGGTGAAACCCTGTCTCTACTAAAGATACAAAAAATTAGCCGGGCGTGTTGGTGTGCACCTGTAATCCCAGCTACTCCGGGAGGCTGAGGCAGGAGAGTCACTTGAACCGGGGAGGCGGAGGTTGCAGTGAGCCGAGATCATGCCATTGCATTCCAGCCTTGGCGACAGAGCGAGACTCCGTCT

SEQ ID NO: 38 - protein, 769 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEI

SEQ ID NO: 39 - protein, 2472 aa, Homo sapiens
GGTACCGTAACCATGGTCAGCTGGGGTCGTTTCATCTGCCTGGTCGTGGTCACCATGGCAACCTTGTCCCTGGCCCGGCCCTCCTTCAGTTTAGTTGAGGATACCACATTAGAGCCAGAAGAGCCACCAACCAAATACCAAATCTCTCAACCAGAAGTGTACGTGGCTGCGCCAGGGGAGTCGCTAGAGGTGCGCTGCCTGTTGAAAGATGCCGCCGTGATCAGTTGGACTAAGGATGGGGTGCACTTGGGGCCCAACAATAGGACAGTGCTTATTGGGGAGTACTTGCAGATAAAGGGCGCCACGCCTAGAGACTCCGGCCTCTATGCTTGTACTGCCAGTAGGACTGTAGACAGTGAAACTTGGTACTTCATGGTGAATGTCACAGATGCCATCTCATCCGGAGATGATGAGGATGACACCGATGGTGCGGAAGATTTTGTCAGTGAGAACAGTAACAACAAGAGAGCACCATACTGGACCAACACAGAAAAGATGGAAAAGCGGCTCCATGCTGTGCCTGCGGCCAACACTGTCAAGTTTCGCTGCCCAGCCGGGGGGAACCCAATGCCAACCATGCGGTGGCTGAAAAACGGGAAGGAGTTTAAGCAGGAGCATCGCATTGGAGGCTACAAGGTACGAAACCAGCACTGGAGCCTCATTATGGAAAGTGTGGTCCCATCTGACAAGGGAAATTATACCTGTGTAGTGGAGAATGAATACGGGTCCATCAATCACACGTACCACCTGGATGTTGTGGAGCGATCGCCTCACCGGCCCATCCTCCAAGCCGGACTGCCGGCAAATGCCTCCACAGTGGTCGGAGGAGACGTAGAGTTTGTCTGCAAGGTTTACAGTGATGCCCAGCCCCACATCCAGTGGATCAAGCACGTGGAAAAGAACGGCAGTAAATACGGGCCCGACGGGCTGCCCTACCTCAAGGTTCTCAAGGCCGCCGGTGTTAACACCACGGACAAAGAGATTGAGGTTCTCTATATTCGGAATGTAACTTTTGAGGACGCTGGGGAATATACGTGCTTGGCGGGTAATTCTATTGGGATATCCTTTCACTCTGCATGGTTGACAGTTCTGCCAGCGCCTGGAAGAGAAAAGGAGATTACAGCTTCCCCAGACTACCTGGAGATAGCCATTTACTGCATAGGGGTCTTCTTAATCGCCTGTATGGTGGTAACAGTCATCCTGTGCCGAATGAAGAACACGACCAAGAAGCCAGACTTCAGCAGCCAGCCGGCTGTGCACAAGCTGACCAAACGTATCCCCCTGCGGAGACAGGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGGAATACTTGGACCTCAGCCAACCTCTCGAACAGTATTCACCTAGTTACCCTGACACAAGAAGTTCTTGTTCTTCAGGAGATGATTCTGTTTTTTCTCCAGACCCCATGCCTTACGAACCATGCCTTCCTCAGTATCCACACATAAACGGCAGTGTTAAAACATGA

SEQ ID NO: 40 - protein, 819 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 41 - protein, 4306 aa, Homo sapiens
AGTGCGCGGTGGCGGCGGCGTCGCGGGCAGCTGGCGCCGCGCGGTCCTGCTCTGCCGGTCGCACGGACGCACCGGCGGGCCGCCGGCCGGAGGGACGGGGCGGGAGCTGGGCCCGCGGACAGCGAGCCGGAGCGGGAGCCGCGCGTAGCGAGCCGGGCTCCGGCGCTCGCCAGTCTCCCGAGCGGCGCCCGCCTCCCGCCGGTGCCCGCGCCGGGCCGTGGGGGGCAGCATGCCCGCGCGCGCTGCCTGAGGACGCCGCGGCCCCCGCCCCCGCCATGGGCGCCCCTGCCTGCGCCCTCGCGCTCTGCGTGGCCGTGGCCATCGTGGCCGGCGCCTCCTCGGAGTCCTTGGGGACGGAGCAGCGCGTCGTGGGGCGAGCGGCAGAAGTCCCGGGCCCAGAGCCCGGCCAGCAGGAGCAGTTGGTCTTCGGCAGCGGGGATGCTGTGGAGCTGAGCTGTCCCCCGCCCGGGGGTGGTCCCATGGGGCCCACTGTCTGGGTCAAGGATGGCACAGGGCTGGTGCCCTCGGAGCGTGTCCTGGTGGGGCCCCAGCGGCTGCAGGTGCTGAATGCCTCCCACGAGGACTCCGGGGCCTACAGCTGCCGGCAGCGGCTCACGCAGCGCGTACTGTGCCACTTCAGTGTGCGGGTGACAGACGCTCCATCCTCGGGAGATGACGAAGACGGGGAGGACGAGGCTGAGGACACAGGTGTGGACACAGGGGCCCCTTACTGGACACGGCCCGAGCGGATGGACAAGAAGCTGCTGGCCGTGCCGGCCGCCAACACCGTCCGCTTCCGCTGCCCAGCCGCTGGCAACCCCACTCCCTCCATCTCCTGGCTGAAGAACGGCAGGGAGTTCCGCGGCGAGCACCGCATTGGAGGCATCAAGCTGCGGCATCAGCAGTGGAGCCTGGTCATGGAAAGCGTGGTGCCCTCGGACCGCGGCAACTACACCTGCGTCGTGGAGAACAAGTTTGGCAGCATCCGGCAGACGTACACGCTGGACGTGCTGGAGCGCTCCCCGCACCGGCCCATCCTGCAGGCGGGGCTGCCGGCCAACCAGACGGCGGTGCTGGGCAGCGACGTGGAGTTCCACTGCAAGGTGTACAGTGACGCACAGCCCCACATCCAGTGGCTCAAGCACGTGGAGGTGAATGGCAGCAAGGTGGGCCCGGACGGCACACCCTACGTTACCGTGCTCAAGACGGCGGGCGCTAACACCACCGACAAGGAGCTAGAGGTTCTCTCCTTGCACAACGTCACCTTTGAGGACGCCGGGGAGTACACCTGCCTGGCGGGCAATTCTATTGGGTTTTCTCATCACTCTGCGTGGCTGGTGGTGCTGCCAGCCGAGGAGGAGCTGGTGGAGGCTGACGAGGCGGGCAGTGTGTATGCAGGCATCCTCAGCTACGGGGTGGGCTTCTTCCTGTTCATCCTGGTGGTGGCGGCTGTGACGCTCTGCCGCCTGCGCAGCCCCCCCAAGAAAGGCCTGGGCTCCCCCACCGTGCACAAGATCTCCCGCTTCCCGCTCAAGCGACAGGTGTCCCTGGAGTCCAACGCGTCCATGAGCTCCAACACACCACTGGTGCGCATCGCAAGGCTGTCCTCAGGGGAGGGCCCCACGCTGGCCAATGTCTCCGAGCTCGAGCTGCCTGCCGACCCCAAATGGGAGCTGTCTCGGGCCCGGCTGACCCTGGGCAAGCCCCTTGGGGAGGGCTGCTTCGGCCAGGTGGTCATGGCGGAGGCCATCGGCATTGACAAGGACCGGGCCGCCAAGCCTGTCACCGTAGCCGTGAAGATGCTGAAAGACGATGCCACTGACAAGGACCTGTCGGACCTGGTGTCTGAGATGGAGATGATGAAGATGATCGGGAAACACAAAAACATCATCAACCTGCTGGGCGCCTGCACGCAGGGCGGGCCCCTGTACGTGCTGGTGGAGTACGCGGCCAAGGGTAACCTGCGGGAGTTTCTGCGGGCGCGGCGGCCCCCGGGCCTGGACTACTCCTTCGACACCTGCAAGCCGCCCGAGGAGCAGCTCACCTTCAAGGACCTGGTGTCCTGTGCCTACCAGGTGGCCCGGGGCATGGAGTACTTGGCCTCCCAGAAGTGCATCCACAGGGACCTGGCTGCCCGCAATGTGCTGGTGACCGAGGACAACGTGATGAAGATCGCAGACTTCGGGCTGGCCCGGGACGTGCACAACCTCGACTACTACAAGAAGACGACCAACGGCCGGCTGCCCGTGAAGTGGATGGCGCCTGAGGCCTTGTTTGACCGAGTCTACACTCACCAGAGTGACGTCTGGTCCTTTGGGGTCCTGCTCTGGGAGATCTTCACGCTGGGGGGCTCCCCGTACCCCGGCATCCCTGTGGAGGAGCTCTTCAAGCTGCTGAAGGAGGGCCACCGCATGGACAAGCCCGCCAACTGCACACACGACCTGTACATGATCATGCGGGAGTGCTGGCATGCCGCGCCCTCCCAGAGGCCCACCTTCAAGCAGCTGGTGGAGGACCTGGACCGTGTCCTTACCGTGACGTCCACCGACGAGTACCTGGACCTGTCGGCGCCTTTCGAGCAGTACTCCCCGGGTGGCCAGGACACCCCCAGCTCCAGCTCCTCAGGGGACGACTCCGTGTTTGCCCACGACCTGCTGCCCCCGGCCCCACCCAGCAGTGGGGGCTCGCGGACGTGAAGGGCCACTGGTCCCCAACAATGTGAGGGGTCCCTAGCAGCCCACCCTGCTGCTGGTGCACAGCCACTCCCCGGCATGAGACTCAGTGCAGATGGAGAGACAGCTACACAGAGCTTTGGTCTGTGTGTGTGTGTGTGCGTGTGTGTGTGTGTGTGTGCACATCCGCGTGTGCCTGTGTGCGTGCGCATCTTGCCTCCAGGTGCAGAGGTACCCTGGGTGTCCCCGCTGCTGTGCAACGGTCTCCTGACTGGTGCTGCAGCACCGAGGGGCCTTTGTTCTGGGGGGACCCAGTGCAGAATGTAAGTGGGCCCACCCGGTGGGACCCCCGTGGGGCAGGGAGCTGGGCCCGACATGGCTCCGGCCTCTGCCTTTGCACCACGGGACATCACAGGGTGGGCCTCGGCCCCTCCCACACCCAAAGCTGAGCCTGCAGGGAAGCCCCACATGTCCAGCACCTTGTGCCTGGGGTGTTAGTGGCACCGCCTCCCCACCTCCAGGCTTTCCCACTTCCCACCCTGCCCCTCAGAGACTGAAATTACGGGTACCTGAAGATGGGAGCCTTTACCTTTTATGCAAAAGGTTTATTCCGGAAACTAGTGTACATTTCTATAAATAGATGCTGTGTATATGGTATATATACATATATATATATAACATATATGGAAGAGGAAAAGGCTGGTACAACGGAGGCCTGCGACCCTGGGGGCACAGGAGGCAGGCATGGCCCTGGGCGGGGCGTGGGGGGGCGTGGAGGGAGGCCCCAGGGGGTCTCACCCATGCAAGCAGAGGACCAGGGCCTTTTCTGGCACCGCAGTTTTGTTTTAAAACTGGACCTGTATATTTGTAAAGCTATTTATGGGCCCCTGGCACTCTTGTTCCCACACCCCAACACTTCCAGCATTTAGCTGGCCACATGGCGGAGAGTTTTAATTTTTAACTTATTGACAACCGAGAAGGTTTATCCCGCCGATAGAGGGACGGCCAAGAATGTACGTCCAGCCTGCCCCGGAGCTGGAGGATCCCCTCCAAGCCTAAAAGGTTGTTAATAGTTGGAGGTGATTCCAGTGAAGATATTTTATTTCCTTTGTCCTTTTTCAGGAGAATTAGATTTCTATAGGATTTTTCTTTAGGAGATTTATTTTTTGGACTTCAAAGCAAGCTGGTATTTTCATACAAATTCTTCTAATTGCTGTGTGTCCCAGGCAGGGAGACGGTTTCCAGGGAGGGGCCGGCCCTGTGTGCAGGTTCCGATGTTATTAGATGTTACAAGTTTATATATATCTATATATATAATTTATTGAGTTTTTACAAGATGTATTTGTTGTAGACTTAACACTTCTTACGCAATGCTTCTAGAGTTTTATAGCCTGGACTGCTACCTTTCAAAGCTTGGAGGGAAGCCGTGAATTCAGTTGGTTCGTTCTGTACTGTTACTGGGCCCTGAGTCTGGGCAGCTGTCCCTTGCTTGCCTGCAGGGCCATGGCTCAGGGTGGTCTCTTCTTGGGGCCCAGTGCATGGTGGCCAGAGGTGTCACCCAAACCGGCAGGTGCGATTTTGTTAACCCAGCGACGAACTTTCCGAAAAATAAAGACACCTGGTTGCTAACCTGG

SEQ ID NO: 42 - protein, 806 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 43 - protein, 4293 aa, Homo sapiens
GTCGCGGGCAGCTGGCGCCGCGCGGTCCTGCTCTGCCGGTCGCACGGACGCACCGGCGGGCCGCCGGCCGGAGGGACGGGGCGGGAGCTGGGCCCGCGGACAGCGAGCCGGAGCGGGAGCCGCGCGTAGCGAGCCGGGCTCCGGCGCTCGCCAGTCTCCCGAGCGGCGCCCGCCTCCCGCCGGTGCCCGCGCCGGGCCGTGGGGGGCAGCATGCCCGCGCGCGCTGCCTGAGGACGCCGCGGCCCCCGCCCCCGCCATGGGCGCCCCTGCCTGCGCCCTCGCGCTCTGCGTGGCCGTGGCCATCGTGGCCGGCGCCTCCTCGGAGTCCTTGGGGACGGAGCAGCGCGTCGTGGGGCGAGCGGCAGAAGTCCCGGGCCCAGAGCCCGGCCAGCAGGAGCAGTTGGTCTTCGGCAGCGGGGATGCTGTGGAGCTGAGCTGTCCCCCGCCCGGGGGTGGTCCCATGGGGCCCACTGTCTGGGTCAAGGATGGCACAGGGCTGGTGCCCTCGGAGCGTGTCCTGGTGGGGCCCCAGCGGCTGCAGGTGCTGAATGCCTCCCACGAGGACTCCGGGGCCTACAGCTGCCGGCAGCGGCTCACGCAGCGCGTACTGTGCCACTTCAGTGTGCGGGTGACAGACGCTCCATCCTCGGGAGATGACGAAGACGGGGAGGACGAGGCTGAGGACACAGGTGTGGACACAGGGGCCCCTTACTGGACACGGCCCGAGCGGATGGACAAGAAGCTGCTGGCCGTGCCGGCCGCCAACACCGTCCGCTTCCGCTGCCCAGCCGCTGGCAACCCCACTCCCTCCATCTCCTGGCTGAAGAACGGCAGGGAGTTCCGCGGCGAGCACCGCATTGGAGGCATCAAGCTGCGGCATCAGCAGTGGAGCCTGGTCATGGAAAGCGTGGTGCCCTCGGACCGCGGCAACTACACCTGCGTCGTGGAGAACAAGTTTGGCAGCATCCGGCAGACGTACACGCTGGACGTGCTGGAGCGCTCCCCGCACCGGCCCATCCTGCAGGCGGGGCTGCCGGCCAACCAGACGGCGGTGCTGGGCAGCGACGTGGAGTTCCACTGCAAGGTGTACAGTGACGCACAGCCCCACATCCAGTGGCTCAAGCACGTGGAGGTGAATGGCAGCAAGGTGGGCCCGGACGGCACACCCTACGTTACCGTGCTCAAGTCCTGGATCAGTGAGAGTGTGGAGGCCGACGTGCGCCTCCGCCTGGCCAATGTGTCGGAGCGGGACGGGGGCGAGTACCTCTGTCGAGCCACCAATTTCATAGGCGTGGCCGAGAAGGCCTTTTGGCTGAGCGTTCACGGGCCCCGAGCAGCCGAGGAGGAGCTGGTGGAGGCTGACGAGGCGGGCAGTGTGTATGCAGGCATCCTCAGCTACGGGGTGGGCTTCTTCCTGTTCATCCTGGTGGTGGCGGCTGTGACGCTCTGCCGCCTGCGCAGCCCCCCCAAGAAAGGCCTGGGCTCCCCCACCGTGCACAAGATCTCCCGCTTCCCGCTCAAGCGACAGGTGTCCCTGGAGTCCAACGCGTCCATGAGCTCCAACACACCACTGGTGCGCATCGCAAGGCTGTCCTCAGGGGAGGGCCCCACGCTGGCCAATGTCTCCGAGCTCGAGCTGCCTGCCGACCCCAAATGGGAGCTGTCTCGGGCCCGGCTGACCCTGGGCAAGCCCCTTGGGGAGGGCTGCTTCGGCCAGGTGGTCATGGCGGAGGCCATCGGCATTGACAAGGACCGGGCCGCCAAGCCTGTCACCGTAGCCGTGAAGATGCTGAAAGACGATGCCACTGACAAGGACCTGTCGGACCTGGTGTCTGAGATGGAGATGATGAAGATGATCGGGAAACACAAAAACATCATCAACCTGCTGGGCGCCTGCACGCAGGGCGGGCCCCTGTACGTGCTGGTGGAGTACGCGGCCAAGGGTAACCTGCGGGAGTTTCTGCGGGCGCGGCGGCCCCCGGGCCTGGACTACTCCTTCGACACCTGCAAGCCGCCCGAGGAGCAGCTCACCTTCAAGGACCTGGTGTCCTGTGCCTACCAGGTGGCCCGGGGCATGGAGTACTTGGCCTCCCAGAAGTGCATCCACAGGGACCTGGCTGCCCGCAATGTGCTGGTGACCGAGGACAACGTGATGAAGATCGCAGACTTCGGGCTGGCCCGGGACGTGCACAACCTCGACTACTACAAGAAGACGACCAACGGCCGGCTGCCCGTGAAGTGGATGGCGCCTGAGGCCTTGTTTGACCGAGTCTACACTCACCAGAGTGACGTCTGGTCCTTTGGGGTCCTGCTCTGGGAGATCTTCACGCTGGGGGGCTCCCCGTACCCCGGCATCCCTGTGGAGGAGCTCTTCAAGCTGCTGAAGGAGGGCCACCGCATGGACAAGCCCGCCAACTGCACACACGACCTGTACATGATCATGCGGGAGTGCTGGCATGCCGCGCCCTCCCAGAGGCCCACCTTCAAGCAGCTGGTGGAGGACCTGGACCGTGTCCTTACCGTGACGTCCACCGACGAGTACCTGGACCTGTCGGCGCCTTTCGAGCAGTACTCCCCGGGTGGCCAGGACACCCCCAGCTCCAGCTCCTCAGGGGACGACTCCGTGTTTGCCCACGACCTGCTGCCCCCGGCCCCACCCAGCAGTGGGGGCTCGCGGACGTGAAGGGCCACTGGTCCCCAACAATGTGAGGGGTCCCTAGCAGCCCACCCTGCTGCTGGTGCACAGCCACTCCCCGGCATGAGACTCAGTGCAGATGGAGAGACAGCTACACAGAGCTTTGGTCTGTGTGTGTGTGTGTGCGTGTGTGTGTGTGTGTGTGCACATCCGCGTGTGCCTGTGTGCGTGCGCATCTTGCCTCCAGGTGCAGAGGTACCCTGGGTGTCCCCGCTGCTGTGCAACGGTCTCCTGACTGGTGCTGCAGCACCGAGGGGCCTTTGTTCTGGGGGGACCCAGTGCAGAATGTAAGTGGGCCCACCCGGTGGGACCCCCGTGGGGCAGGGAGCTGGGCCCGACATGGCTCCGGCCTCTGCCTTTGCACCACGGGACATCACAGGGTGGGCCTCGGCCCCTCCCACACCCAAAGCTGAGCCTGCAGGGAAGCCCCACATGTCCAGCACCTTGTGCCTGGGGTGTTAGTGGCACCGCCTCCCCACCTCCAGGCTTTCCCACTTCCCACCCTGCCCCTCAGAGACTGAAATTACGGGTACCTGAAGATGGGAGCCTTTACCTTTTATGCAAAAGGTTTATTCCGGAAACTAGTGTACATTTCTATAAATAGATGCTGTGTATATGGTATATATACATATATATATATAACATATATGGAAGAGGAAAAGGCTGGTACAACGGAGGCCTGCGACCCTGGGGGCACAGGAGGCAGGCATGGCCCTGGGCGGGGCGTGGGGGGGCGTGGAGGGAGGCCCCAGGGGGTCTCACCCATGCAAGCAGAGGACCAGGGCCTTTTCTGGCACCGCAGTTTTGTTTTAAAACTGGACCTGTATATTTGTAAAGCTATTTATGGGCCCCTGGCACTCTTGTTCCCACACCCCAACACTTCCAGCATTTAGCTGGCCACATGGCGGAGAGTTTTAATTTTTAACTTATTGACAACCGAGAAGGTTTATCCCGCCGATAGAGGGACGGCCAAGAATGTACGTCCAGCCTGCCCCGGAGCTGGAGGATCCCCTCCAAGCCTAAAAGGTTGTTAATAGTTGGAGGTGATTCCAGTGAAGATATTTTATTTCCTTTGTCCTTTTTCAGGAGAATTAGATTTCTATAGGATTTTTCTTTAGGAGATTTATTTTTTGGACTTCAAAGCAAGCTGGTATTTTCATACAAATTCTTCTAATTGCTGTGTGTCCCAGGCAGGGAGACGGTTTCCAGGGAGGGGCCGGCCCTGTGTGCAGGTTCCGATGTTATTAGATGTTACAAGTTTATATATATCTATATATATAATTTATTGAGTTTTTACAAGATGTATTTGTTGTAGACTTAACACTTCTTACGCAATGCTTCTAGAGTTTTATAGCCTGGACTGCTACCTTTCAAAGCTTGGAGGGAAGCCGTGAATTCAGTTGGTTCGTTCTGTACTGTTACTGGGCCCTGAGTCTGGGCAGCTGTCCCTTGCTTGCCTGCAGGGCCATGGCTCAGGGTGGTCTCTTCTTGGGGCCCAGTGCATGGTGGCCAGAGGTGTCACCCAAACCGGCAGGTGCGATTTTGTTAACCCAGCGACGAACTTTCCGAAAAATAAAGACACCTGGTTGCTAACCTGG

SEQ ID NO: 44 - protein, 808 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKSWISESVEADVRLRLANVSERDGGEYLCRATNFIGVAEKAFWLSVHGPRAAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 45 - protein, 3951 aa, Homo sapiens
GTCGCGGGCAGCTGGCGCCGCGCGGTCCTGCTCTGCCGGTCGCACGGACGCACCGGCGGGCCGCCGGCCGGAGGGACGGGGCGGGAGCTGGGCCCGCGGACAGCGAGCCGGAGCGGGAGCCGCGCGTAGCGAGCCGGGCTCCGGCGCTCGCCAGTCTCCCGAGCGGCGCCCGCCTCCCGCCGGTGCCCGCGCCGGGCCGTGGGGGGCAGCATGCCCGCGCGCGCTGCCTGAGGACGCCGCGGCCCCCGCCCCCGCCATGGGCGCCCCTGCCTGCGCCCTCGCGCTCTGCGTGGCCGTGGCCATCGTGGCCGGCGCCTCCTCGGAGTCCTTGGGGACGGAGCAGCGCGTCGTGGGGCGAGCGGCAGAAGTCCCGGGCCCAGAGCCCGGCCAGCAGGAGCAGTTGGTCTTCGGCAGCGGGGATGCTGTGGAGCTGAGCTGTCCCCCGCCCGGGGGTGGTCCCATGGGGCCCACTGTCTGGGTCAAGGATGGCACAGGGCTGGTGCCCTCGGAGCGTGTCCTGGTGGGGCCCCAGCGGCTGCAGGTGCTGAATGCCTCCCACGAGGACTCCGGGGCCTACAGCTGCCGGCAGCGGCTCACGCAGCGCGTACTGTGCCACTTCAGTGTGCGGGTGACAGACGCTCCATCCTCGGGAGATGACGAAGACGGGGAGGACGAGGCTGAGGACACAGGTGTGGACACAGGGGCCCCTTACTGGACACGGCCCGAGCGGATGGACAAGAAGCTGCTGGCCGTGCCGGCCGCCAACACCGTCCGCTTCCGCTGCCCAGCCGCTGGCAACCCCACTCCCTCCATCTCCTGGCTGAAGAACGGCAGGGAGTTCCGCGGCGAGCACCGCATTGGAGGCATCAAGCTGCGGCATCAGCAGTGGAGCCTGGTCATGGAAAGCGTGGTGCCCTCGGACCGCGGCAACTACACCTGCGTCGTGGAGAACAAGTTTGGCAGCATCCGGCAGACGTACACGCTGGACGTGCTGGAGCGCTCCCCGCACCGGCCCATCCTGCAGGCGGGGCTGCCGGCCAACCAGACGGCGGTGCTGGGCAGCGACGTGGAGTTCCACTGCAAGGTGTACAGTGACGCACAGCCCCACATCCAGTGGCTCAAGCACGTGGAGGTGAATGGCAGCAAGGTGGGCCCGGACGGCACACCCTACGTTACCGTGCTCAAGGTGTCCCTGGAGTCCAACGCGTCCATGAGCTCCAACACACCACTGGTGCGCATCGCAAGGCTGTCCTCAGGGGAGGGCCCCACGCTGGCCAATGTCTCCGAGCTCGAGCTGCCTGCCGACCCCAAATGGGAGCTGTCTCGGGCCCGGCTGACCCTGGGCAAGCCCCTTGGGGAGGGCTGCTTCGGCCAGGTGGTCATGGCGGAGGCCATCGGCATTGACAAGGACCGGGCCGCCAAGCCTGTCACCGTAGCCGTGAAGATGCTGAAAGACGATGCCACTGACAAGGACCTGTCGGACCTGGTGTCTGAGATGGAGATGATGAAGATGATCGGGAAACACAAAAACATCATCAACCTGCTGGGCGCCTGCACGCAGGGCGGGCCCCTGTACGTGCTGGTGGAGTACGCGGCCAAGGGTAACCTGCGGGAGTTTCTGCGGGCGCGGCGGCCCCCGGGCCTGGACTACTCCTTCGACACCTGCAAGCCGCCCGAGGAGCAGCTCACCTTCAAGGACCTGGTGTCCTGTGCCTACCAGGTGGCCCGGGGCATGGAGTACTTGGCCTCCCAGAAGTGCATCCACAGGGACCTGGCTGCCCGCAATGTGCTGGTGACCGAGGACAACGTGATGAAGATCGCAGACTTCGGGCTGGCCCGGGACGTGCACAACCTCGACTACTACAAGAAGACGACCAACGGCCGGCTGCCCGTGAAGTGGATGGCGCCTGAGGCCTTGTTTGACCGAGTCTACACTCACCAGAGTGACGTCTGGTCCTTTGGGGTCCTGCTCTGGGAGATCTTCACGCTGGGGGGCTCCCCGTACCCCGGCATCCCTGTGGAGGAGCTCTTCAAGCTGCTGAAGGAGGGCCACCGCATGGACAAGCCCGCCAACTGCACACACGACCTGTACATGATCATGCGGGAGTGCTGGCATGCCGCGCCCTCCCAGAGGCCCACCTTCAAGCAGCTGGTGGAGGACCTGGACCGTGTCCTTACCGTGACGTCCACCGACGAGTACCTGGACCTGTCGGCGCCTTTCGAGCAGTACTCCCCGGGTGGCCAGGACACCCCCAGCTCCAGCTCCTCAGGGGACGACTCCGTGTTTGCCCACGACCTGCTGCCCCCGGCCCCACCCAGCAGTGGGGGCTCGCGGACGTGAAGGGCCACTGGTCCCCAACAATGTGAGGGGTCCCTAGCAGCCCACCCTGCTGCTGGTGCACAGCCACTCCCCGGCATGAGACTCAGTGCAGATGGAGAGACAGCTACACAGAGCTTTGGTCTGTGTGTGTGTGTGTGCGTGTGTGTGTGTGTGTGTGCACATCCGCGTGTGCCTGTGTGCGTGCGCATCTTGCCTCCAGGTGCAGAGGTACCCTGGGTGTCCCCGCTGCTGTGCAACGGTCTCCTGACTGGTGCTGCAGCACCGAGGGGCCTTTGTTCTGGGGGGACCCAGTGCAGAATGTAAGTGGGCCCACCCGGTGGGACCCCCGTGGGGCAGGGAGCTGGGCCCGACATGGCTCCGGCCTCTGCCTTTGCACCACGGGACATCACAGGGTGGGCCTCGGCCCCTCCCACACCCAAAGCTGAGCCTGCAGGGAAGCCCCACATGTCCAGCACCTTGTGCCTGGGGTGTTAGTGGCACCGCCTCCCCACCTCCAGGCTTTCCCACTTCCCACCCTGCCCCTCAGAGACTGAAATTACGGGTACCTGAAGATGGGAGCCTTTACCTTTTATGCAAAAGGTTTATTCCGGAAACTAGTGTACATTTCTATAAATAGATGCTGTGTATATGGTATATATACATATATATATATAACATATATGGAAGAGGAAAAGGCTGGTACAACGGAGGCCTGCGACCCTGGGGGCACAGGAGGCAGGCATGGCCCTGGGCGGGGCGTGGGGGGGCGTGGAGGGAGGCCCCAGGGGGTCTCACCCATGCAAGCAGAGGACCAGGGCCTTTTCTGGCACCGCAGTTTTGTTTTAAAACTGGACCTGTATATTTGTAAAGCTATTTATGGGCCCCTGGCACTCTTGTTCCCACACCCCAACACTTCCAGCATTTAGCTGGCCACATGGCGGAGAGTTTTAATTTTTAACTTATTGACAACCGAGAAGGTTTATCCCGCCGATAGAGGGACGGCCAAGAATGTACGTCCAGCCTGCCCCGGAGCTGGAGGATCCCCTCCAAGCCTAAAAGGTTGTTAATAGTTGGAGGTGATTCCAGTGAAGATATTTTATTTCCTTTGTCCTTTTTCAGGAGAATTAGATTTCTATAGGATTTTTCTTTAGGAGATTTATTTTTTGGACTTCAAAGCAAGCTGGTATTTTCATACAAATTCTTCTAATTGCTGTGTGTCCCAGGCAGGGAGACGGTTTCCAGGGAGGGGCCGGCCCTGTGTGCAGGTTCCGATGTTATTAGATGTTACAAGTTTATATATATCTATATATATAATTTATTGAGTTTTTACAAGATGTATTTGTTGTAGACTTAACACTTCTTACGCAATGCTTCTAGAGTTTTATAGCCTGGACTGCTACCTTTCAAAGCTTGGAGGGAAGCCGTGAATTCAGTTGGTTCGTTCTGTACTGTTACTGGGCCCTGAGTCTGGGCAGCTGTCCCTTGCTTGCCTGCAGGGCCATGGCTCAGGGTGGTCTCTTCTTGGGGCCCAGTGCATGGTGGCCAGAGGTGTCACCCAAACCGGCAGGTGCGATTTTGTTAACCCAGCGACGAACTTTCCGAAAAATAAAGACACCTGGTTGCTAACCTGG

SEQ ID NO: 46 - protein, 694 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 47 - protein, 2184 aa, Homo sapiens
CGCGCGCTGCCTGAGGACGCCGCGGCCCCCGCCCCCGCCATGGGCGCCCCTGCCTGCGCCCTCGCGCTCTGCGTGGCCGTGGCCATCGTGGCCGGCGCCTCCTCGGAGTCCTTGGGGACGGAGCAGCGCGTCGTGGGGCGAGCGGCAGAAGTCCCGGGCCCAGAGCCCGGCCAGCAGGAGCAGTTGGTCTTCGGCAGCGGGGATGCTGTGGAGCTGAGCTGTCCCCCGCCCGGGGGTGGTCCCATGGGGCCCACTGTCTGGGTCAAGGATGGCACAGGGCTGGTGCCCTCGGAGCGTGTCCTGGTGGGGCCCCAGCGGCTGCAGGTGCTGAATGCCTCCCACGAGGACTCCGGGGCCTACAGCTGCCGGCAGCGGCTCACGCAGCGCGTACTGTGCCACTTCAGTGTGCGGGTGACAGACGCTCCATCCTCGGGAGATGACGAAGACGGGGAGGACGAGGCTGAGGACACAGGTGTGGACACAGGGGCCCCTTACTGGACACGGCCCGAGCGGATGGACAAGAAGCTGCTGGCCGTGCCGGCCGCCAACACCGTCCGCTTCCGCTGCCCAGCCGCTGGCAACCCCACTCCCTCCATCTCCTGGCTGAAGAACGGCAGGGAGTTCCGCGGCGAGCACCGCATTGGAGGCATCAAGCTGCGGCATCAGCAGTGGAGCCTGGTCATGGAAAGCGTGGTGCCCTCGGACCGCGGCAACTACACCTGCGTCGTGGAGAACAAGTTTGGCAGCATCCGGCAGACGTACACGCTGGACGTGCTGGAGCGCTCCCCGCACCGGCCCATCCTGCAGGCGGGGCTGCCGGCCAACCAGACGGCGGTGCTGGGCAGCGACGTGGAGTTCCACTGCAAGGTGTACAGTGACGCACAGCCCCACATCCAGTGGCTCAAGCACGTGGAGGTGAATGGCAGCAAGGTGGGCCCGGACGGCACACCCTACGTTACCGTGCTCAAGGTGTCCCTGGAGTCCAACGCGTCCATGAGCTCCAACACACCACTGGTGCGCATCGCAAGGCTGTCCTCAGGGGAGGGCCCCACGCTGGCCAATGTCTCCGAGCTCGAGCTGCCTGCCGACCCCAAATGGGAGCTGTCTCGGGCCCGGCTGACCCTGGGCAAGCCCCTTGGGGAGGGCTGCTTCGGCCAGGTGGTCATGGCGGAGGCCATCGGCATTGACAAGGACCGGGCCGCCAAGCCTGTCACCGTAGCCGTGAAGATGCTGAAAGACGATGCCACTGACAAGGACCTGTCGGACCTGGTGTCTGAGATGGAGATGATGAAGATGATCGGGAAACACAAAAACATCATCAACCTGCTGGGCGCCTGCACGCAGGGCGGGCCCCTGTACGTGCTGGTGGAGTACGCGGCCAAGGGTAACCTGCGGGAGTTTCTGCGGGCGCGGCGGCCCCCGGGCCTGGACTACTCCTTCGACACCTGCAAGCCGCCCGAGGAGCAGCTCACCTTCAAGGACCTGGTGTCCTGTGCCTACCAGGTGGCCCGGGGCATGGAGTACTTGGCCTCCCAGAAGTGCATCCACAGGGACCTGGCTGCCCGCAATGTGCTGGTGACCGAGGACAACGTGATGAAGATCGCAGACTTCGGGCTGGCCCGGGACGTGCACAACCTCGACTACTACAAGAAGACGACCAACGGCCGGCTGCCCGTGAAGTGGATGGCGCCTGAGGCCTTGTTTGACCGAGTCTACACTCACCAGAGTGACGTCTGGTCCTTTGGGGTCCTGCTCTGGGAGATCTTCACGCTGGGGGGCTCCCCGTACCCCGGCATCCCTGTGGAGGAGCTCTTCAAGCTGCTGAAGGAGGGCCACCGCATGGACAAGCCCGCCAACTGCACACACGACCTGTACATGATCATGCGGGAGTGCTGGCATGCCGCGCCCTCCCAGAGGCCCACCTTCAAGCAGCTGGTGGAGGACCTGGACCGTGTCCTTACCGTGACGTCCACCGACGAGTACCTGGACCTGTCGGCGCCTTTCGAGCAGTACTCCCCGGGTGGCCAGGACACCCCCAGCTCCAGCTCCTCAGGGGACGACTCCGTGTTTGCCCACGACCTGCTGCCCCCGGCCCCACCCAGCAGTGGGGGCTCGCGGACGTGAAGGGCCACTGGTCCCCAACAATGTGAGGGGTCCCTAGCAGCCCACCCTGCTGCTGGTGCA

SEQ ID NO: 48 - protein, 694 aa, Homo sapiens; identical to SEQ ID NO: 46

SEQ ID NO: 49 - protein, 3122 aa, Homo sapiens
CGCTCGCGGCCACGCCGCCGTCGCGGGTACATTCCTCGCTCCCGGCCGAGGAGCGCTCGGGCTGTCTGCGGACCCTGCCGCGTGCAGGGGTCGCGGCCGGCTGGAGCTGGGAGTGAGGCGGCGGAGGAGCCAGGTGAGGAGGAGCCAGGTGAGCAGGACCCTGTGCTGGGCGCGGAGTCACGCAGGCTCGAGGAAGGCAGTTGGTGGGAAGTCCAGCTTGGGTCCCTGAGAGCTGTGAGAAGGAGATGCGGCTGCTGCTGGCCCTGTTGGGGGTCCTGCTGAGTGTGCCTGGGCCTCCAGTCTTGTCCCTGGAGGCCTCTGAGGAAGTGGAGCTTGAGCCCTGCCTGGCTCCCAGCCTGGAGCAGCAAGAGCAGGAGCTGACAGTAGCCCTTGGGCAGCCTGTGCGTCTGTGCTGTGGGCGGGCTGAGCGTGGTGGCCACTGGTACAAGGAGGGCAGTCGCCTGGCACCTGCTGGCCGTGTACGGGGCTGGAGGGGCCGCCTAGAGATTGCCAGCTTCCTACCTGAGGATGCTGGCCGCTACCTCTGCCTGGCACGAGGCTCCATGATCGTCCTGCAGAATCTCACCTTGATTACAGGTGACTCCTTGACCTCCAGCAACGATGATGAGGACCCCAAGTCCCATAGGGACCCCTCGAATAGGCACAGTTACCCCCAGCAAGCACCCTACTGGACACACCCCCAGCGCATGGAGAAGAAACTGCATGCAGTACCTGCGGGGAACACCGTCAAGTTCCGCTGTCCAGCTGCAGGCAACCCCACGCCCACCATCCGCTGGCTTAAGGATGGACAGGCCTTTCATGGGGAGAACCGCATTGGAGGCATTCGGCTGCGCCATCAGCACTGGAGTCTCGTGATGGAGAGCGTGGTGCCCTCGGACCGCGGCACATACACCTGCCTGGTAGAGAACGCTGTGGGCAGCATCCGCTATAACTACCTGCTAGATGTGCTGGAGCGGTCCCCGCACCGGCCCATCCTGCAGGCCGGGCTCCCGGCCAACACCACAGCCGTGGTGGGCAGCGACGTGGAGCTGCTGTGCAAGGTGTACAGCGATGCCCAGCCCCACATCCAGTGGCTGAAGCACATCGTCATCAACGGCAGCAGCTTCGGAGCCGACGGTTTCCCCTATGTGCAAGTCCTAAAGACTGCAGACATCAATAGCTCAGAGGTGGAGGTCCTGTACCTGCGGAACGTGTCAGCCGAGGACGCAGGCGAGTACACCTGCCTCGCAGGCAATTCCATCGGCCTCTCCTACCAGTCTGCCTGGCTCACGGTGCTGCCAGAGGAGGACCCCACATGGACCGCAGCAGCGCCCGAGGCCAGGTATACGGACATCATCCTGTACGCGTCGGGCTCCCTGGCCTTGGCTGTGCTCCTGCTGCTGGCCGGGCTGTATCGAGGGCAGGCGCTCCACGGCCGGCACCCCCGCCCGCCCGCCACTGTGCAGAAGCTCTCCCGCTTCCCTCTGGCCCGACAGTTCTCCCTGGAGTCAGGCTCTTCCGGCAAGTCAAGCTCATCCCTGGTACGAGGCGTGCGTCTCTCCTCCAGCGGCCCCGCCTTGCTCGCCGGCCTCGTGAGTCTAGATCTACCTCTCGACCCACTATGGGAGTTCCCCCGGGACAGGCTGGTGCTTGGGAAGCCCCTAGGCGAGGGCTGCTTTGGCCAGGTAGTACGTGCAGAGGCCTTTGGCATGGACCCTGCCCGGCCTGACCAAGCCAGCACTGTGGCCGTCAAGATGCTCAAAGACAACGCCTCTGACAAGGACCTGGCCGACCTGGTCTCGGAGATGGAGGTGATGAAGCTGATCGGCCGACACAAGAACATCATCAACCTGCTTGGTGTCTGCACCCAGGAAGGGCCCCTGTACGTGATCGTGGAGTGCGCCGCCAAGGGAAACCTGCGGGAGTTCCTGCGGGCCCGGCGCCCCCCAGGCCCCGACCTCAGCCCCGACGGTCCTCGGAGCAGTGAGGGGCCGCTCTCCTTCCCAGTCCTGGTCTCCTGCGCCTACCAGGTGGCCCGAGGCATGCAGTATCTGGAGTCCCGGAAGTGTATCCACCGGGACCTGGCTGCCCGCAATGTGCTGGTGACTGAGGACAATGTGATGAAGATTGCTGACTTTGGGCTGGCCCGCGGCGTCCACCACATTGACTACTATAAGAAAACCAGCAACGGCCGCCTGCCTGTGAAGTGGATGGCGCCCGAGGCCTTGTTTGACCGGGTGTACACACACCAGAGTGACGTGTGGTCTTTTGGGATCCTGCTATGGGAGATCTTCACCCTCGGGGGCTCCCCGTATCCTGGCATCCCGGTGGAGGAGCTGTTCTCGCTGCTGCGGGAGGGACATCGGATGGACCGACCCCCACACTGCCCCCCAGAGCTGTACGGGCTGATGCGTGAGTGCTGGCACGCAGCGCCCTCCCAGAGGCCTACCTTCAAGCAGCTGGTGGAGGCGCTGGACAAGGTCCTGCTGGCCGTCTCTGAGGAGTACCTCGACCTCCGCCTGACCTTCGGACCCTATTCCCCCTCTGGTGGGGACGCCAGCAGCACCTGCTCCTCCAGCGATTCTGTCTTCAGCCACGACCCCCTGCCATTGGGATCCAGCTCCTTCCCCTTCGGGTCTGGGGTGCAGACATGAGCAAGGCTCAAGGCTGTGCAGGCACATAGGCTGGTGGCCTTGGGCCTTGGGGCTCAGCCACAGCCTGACACAGTGCTCGACCTTGATAGCATGGGGCCCCTGGCCCAGAGTTGCTGTGCCGTGTCCAAGGGCCGTGCCCTTGCCCTTGGAGCTGCCGTGCCTGTGTCCTGATGGCCCAAATGTCAGGGTTCTGCTCGGCTTCTTGGACCTTGGCGCTTAGTCCCCATCCCGGGTTTGGCTGAGCCTGGCTGGAGAGCTGCTATGCTAAACCTCCTGCCTCCCAATACCAGCAGGAGGTTCTGGGCCTCTGAACCCCCTTTCCCCACACCTCCCCCTGCTGCTGCTGCCCCAGCGTCTTGACGGGAGCATTGGCCCCTGAGCCCAGAGAAGCTGGAAGCCTGCCGAAAACAGGAGCAAATGGCGTTTTATAAATTATTTTTTTGAAATAAAGCTCTGTGTGCCTGGGTC

SEQ ID NO: 50 - protein, 802 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTDIILYASGSLALAVLLLLAGLYRGQALHGRHPRPPATVQKLSRFPLARQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 51 - protein, 2733 aa, Homo sapiens
GTCGCGGGTACATTCCTCGCTCCCGGCCGAGGAGCGCTCGGGCTGTCTGCGGACCCTGCCGCGTGCAGGGGTCGCGGCCGGCTGGAGCTGGGAGTGAGGCGGCGGAGGAGCCAGGTGAGGAGGAGCCAGGAAGGCAGTTGGTGGGAAGTCCAGCTTGGGTCCCTGAGAGCTGTGAGAAGGAGATGCGGCTGCTGCTGGCCCTGTTGGGGGTCCTGCTGAGTGTGCCTGGGCCTCCAGTCTTGTCCCTGGAGGCCTCTGAGGAAGTGGAGCTTGAGCCCTGCCTGGCTCCCAGCCTGGAGCAGCAAGAGCAGGAGCTGACAGTAGCCCTTGGGCAGCCTGTGCGTCTGTGCTGTGGGCGGGCTGAGCGTGGTGGCCACTGGTACAAGGAGGGCAGTCGCCTGGCACCTGCTGGCCGTGTACGGGGCTGGAGGGGCCGCCTAGAGATTGCCAGCTTCCTACCTGAGGATGCTGGCCGCTACCTCTGCCTGGCACGAGGCTCCATGATCGTCCTGCAGAATCTCACCTTGATTACAGGTGACTCCTTGACCTCCAGCAACGATGATGAGGACCCCAAGTCCCATAGGGACCCCTCGAATAGGCACAGTTACCCCCAGCAAGCACCCTACTGGACACACCCCCAGCGCATGGAGAAGAAACTGCATGCAGTACCTGCGGGGAACACCGTCAAGTTCCGCTGTCCAGCTGCAGGCAACCCCACGCCCACCATCCGCTGGCTTAAGGATGGACAGGCCTTTCATGGGGAGAACCGCATTGGAGGCATTCGGCTGCGCCATCAGCACTGGAGTCTCGTGATGGAGAGCGTGGTGCCCTCGGACCGCGGCACATACACCTGCCTGGTAGAGAACGCTGTGGGCAGCATCCGCTATAACTACCTGCTAGATGTGCTGGAGCGGTCCCCGCACCGGCCCATCCTGCAGGCCGGGCTCCCGGCCAACACCACAGCCGTGGTGGGCAGCGACGTGGAGCTGCTGTGCAAGGTGTACAGCGATGCCCAGCCCCACATCCAGTGGCTGAAGCACATCGTCATCAACGGCAGCAGCTTCGGAGCCGACGGTTTCCCCTATGTGCAAGTCCTAAAGACTGCAGACATCAATAGCTCAGAGGTGGAGGTCCTGTACCTGCGGAACGTGTCAGCCGAGGACGCAGGCGAGTACACCTGCCTCGCAGGCAATTCCATCGGCCTCTCCTACCAGTCTGCCTGGCTCACGGTGCTGCCAGAGGAGGACCCCACATGGACCGCAGCAGCGCCCGAGGCCAGTTCTCCCTGGAGTCAGGCTCTTCCGGCAAGTCAAGCTCATCCCTGGTACGAGGCGTGCGTCTCTCCTCCAGCGGCCCCGCCTTGCTCGCCGGCCTCGCTGGTGCTTGGGAAGCCCCTAGGCGAGGGCTGCTTTGGCCAGGTAGTACGTGCAGAGGCCTTTGGCATGGACCCTGCCCGGCCTGACCAAGCCAGCACTGTGGCCGTCAAGATGCTCAAAGACAACGCCTCTGACAAGGACCTGGCCGACCTGGTCTCGGAGATGGAGGTGATGAAGCTGATCGGCCGACACAAGAACATCATCAACCTGCTTGGTGTCTGCACCCAGGAAGGGCCCCTGTACGTGATCGTGGAGTGCGCCGCCAAGGGAAACCTGCGGGAGTTCCTGCGGGCCCGGCGCCCCCCAGGCCCCGACCTCAGCCCCGACGGTCCTCGGAGCAGTGAGGGGCCGCTCTCCTTCCCAGTCCTGGTCTCCTGCGCCTACCAGGTGGCCCGAGGCATGCAGTATCTGGAGTCCCGGAAGTGTATCCACCGGGACCTGGCTGCCCGCAATGTGCTGGTGACTGAGGACAATGTGATGAAGATTGCTGACTTTGGGCTGGCCCGCGGCGTCCACCACATTGACTACTATAAGAAAACCAGCAACGGCCGCCTGCCTGTGAAGTGGATGGCGCCCGAGGCCTTGTTTGACCGGGTGTACACACACCAGAGTGACGTGTGGTCTTTTGGGATCCTGCTATGGGAGATCTTCACCCTCGGGGGCTCCCCGTATCCTGGCATCCCGGTGGAGGAGCTGTTCTCGCTGCTGCGGGAGGGACATCGGATGGACCGACCCCCACACTGCCCCCCAGAGCTGTACGGGCTGATGCGTGAGTGCTGGCACGCAGCGCCCTCCCAGAGGCCTACCTTCAAGCAGCTGGTGGAGGCGCTGGACAAGGTCCTGCTGGCCGTCTCTGAGGAGTACCTCGACCTCCGCCTGACCTTCGGACCCTATTCCCCCTCTGGTGGGGACGCCAGCAGCACCTGCTCCTCCAGCGATTCTGTCTTCAGCCACGACCCCCTGCCATTGGGATCCAGCTCCTTCCCCTTCGGGTCTGGGGTGCAGACATGAGCAAGGCTCAAGGCTGTGCAGGCACATAGGCTGGTGGCCTTGGGCCTTGGGGCTCAGCCACAGCCTGACACAGTGCTCGACCTTGATAGCATGGGGCCCCTGGCCCAGAGTTGCTGTGCCGTGTCCAAGGGCCGTGCCCTTGCCCTTGGAGCTGCCGTGCCTGTGTCCTGATGGCCCAAATGTCAGGGTTCTGCTCGGCTTCTTGGACCTTGGCGCTTAGTCCCCATCCCGGGTTTGGCTGAGCCTGGCTGGAGAGCTGCTATGCTAAACCTCCTGCCTCCCAATACCAGCAGGAGGTTCTGGGCCTCTGAACCCCCTTTCCCCACACCTCCCCCTGCTGCTGCTG

SEQ ID NO: 52 - protein, 734 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEASSPWSQALPASQAHPWYEACVSPPAAPPCSPASLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 53 - protein, 2638 aa, Homo sapiens
ACATTCCTCGCTCCCGGCCGAGGAGCGCTCGGGCTGTCTGCGGACCCTGCCGCGTGCAGGGGTCGCGGCCGGCTGGAGCTGGGAGTGAGGCGGCGGAGGAGCCAGGTGAGGAGGAGCCAGGAAGGCAGTTGGTGGGAAGTCCAGCTTGGGTCCCTGAGAGCTGTGAGAAGGAGATGCGGCTGCTGCTGGCCCTGTTGGGGGTCCTGCTGAGTGTGCCTGGGCCTCCAGTCTTGTCCCTGGAGGCCTCTGAGGAAGTGGAGCTTGAGCCCTGCCTGGCTCCCAGCCTGGAGCAGCAAGAGCAGGAGCTGACAGTAGCCCTTGGGCAGCCTGTGCGTCTGTGCTGTGGGCGGGCTGAGCGTGGTGGCCACTGGTACAAGGAGGGCAGTCGCCTGGCACCTGCTGGCCGTGTACGGGGCTGGAGGGGCCGCCTAGAGATTGCCAGCTTCCTACCTGAGGATGCTGGCCGCTACCTCTGCCTGGCACGAGGCTCCATGATCGTCCTGCAGAATCTCACCTTGATTACAGGTGACTCCTTGACCTCCAGCAACGATGATGAGGACCCCAAGTCCCATAGGGACCCCTCGAATAGGCACAGTTACCCCCAGCAAGCACCCTACTGGACACACCCCCAGCGCATGGAGAAGAAACTGCATGCAGTACCTGCGGGGAACACCGTCAAGTTCCGCTGTCCAGCTGCAGGCAACCCCACGCCCACCATCCGCTGGCTTAAGGATGGACAGGCCTTTCATGGGGAGAACCGCATTGGAGGCATTCGGCTGCGCCATCAGCACTGGAGTCTCGTGATGGAGAGCGTGGTGCCCTCGGACCGCGGCACATACACCTGCCTGGTAGAGAACGCTGTGGGCAGCATCCGCTATAACTACCTGCTAGATGTGCTGGAGCGGTCCCCGCACCGGCCCATCCTGCAGGCCGGGCTCCCGGCCAACACCACAGCCGTGGTGGGCAGCGACGTGGAGCTGCTGTGCAAGGTGTACAGCGATGCCCAGCCCCACATCCAGTGGCTGAAGCACATCGTCATCAACGGCAGCAGCTTCGGAGCCGACGGTTTCCCCTATGTGCAAGTCCTAAAGACTGCAGACATCAATAGCTCAGAGGTGGAGGTCCTGTACCTGCGGAACGTGTCAGCCGAGGACGCAGGCGAGTACACCTGCCTCGCAGGCAATTCCATCGGCCTCTCCTACCAGTCTGCCTGGCTCACGGTGCTGCCAGAGGAGGACCCCACATGGACCGCAGCAGCGCCCGAGGCCAGGTATACGGACATCATCCTGTACGCGTCGGGCTCCCTGGCCTTGGCTGTGCTCCTGCTGCTGGCCGGGCTGTATCGAGGGCAGGCGCTCCACGGCCGGCACCCCCGCCCGCCCGCCACTGTGCAGAAGCTCTCCCGCTTCCCTCTGGCCCGACAGTTCTCCCTGGAGTCAGGCTCTTCCGGCAAGTCAAGCTCATCCCTGGTACGAGGCGTGCGTCTCTCCTCCAGCGGCCCCGCCTTGCTCGCCGGCCTCGTGAGTCTAGATCTACCTCTCGACCCACTATGGGAGTTCCCCCGGGACAGGCTGGTGCTTGGGAAGCCCCTAGGCGAGGGCTGCTTTGGCCAGGTAGTACGTGCAGAGGCCTTTGGCATGGACCCTGCCCGGCCTGACCAAGCCAGCACTGTGGCCGTCAAGATGCTCAAAGACAACGCCTCTGACAAGGACCTGGCCGACCTGGTCTCGGAGATGGAGGTGATGAAGCTGATCGGCCGACACAAGAACATCATCAACCTGCTTGGTGTCTGCACCCAGGAAGGGCCCCTGTACGTGATCGTGGAGTGCGCCGCCAAGGGAAACCTGCGGGAGTTCCTGCGGGCCCGGCGCCCCCCAGGCCCCGACCTCAGCCCCGACGGTCCTCGGAGCAGTGAGGGGCCGCTCTCCTTCCCAGTCCTGGTCTCCTGCGCCTACCAGGTGGCCCGAGGCATGCAGTATCTGGAGTCCCGGAAGTGTATCCACCGGGACCTGGCTGCCCGCAATGTGCTGGTGACTGAGGACAATGTGATGAAGATTGCTGACTTTGGGCTGGCCCGCGGCGTCCACCACATTGACTACTATAAGAAAACCAGCAACGGCCGCCTGCCTGTGAAGTGGATGGCGCCCGAGGCCTTGTTTGACCGGGTGTACACACACCAGAGTGACGTGTGGTCTTTTGGGATCCTGCTATGGGAGATCTTCACCCTCGGGGGCTCCCCGTATCCTGGCATCCCGGTGGAGGAGCTGTTCTCGCTGCTGCGGGAGGGACATCGGATGGACCGACCCCCACACTGCCCCCCAGAGCTGTACGGGCTGATGCGTGAGTGCTGGCACGCAGCGCCCTCCCAGAGGCCTACCTTCAAGCAGCTGGTGGAGGCGCTGGACAAGGTCCTGCTGGCCGTCTCTGAGGAGTACCTCGACCTCCGCCTGACCTTCGGACCCTATTCCCCCTCTGGTGGGGACGCCAGCAGCACCTGCTCCTCCAGCGATTCTGTCTTCAGCCACGACCCCCTGCCATTGGGATCCAGCTCCTTCCCCTTCGGGTCTGGGGTGCAGACATGAGCAAGGCTCAAGGCTGTGCAGGCACATAGGCTGGTGGCCTTGGGCCTTGGGGCTCA

SEQ ID NO: 54 - protein, 802 aa, Homo sapiens; identical to SEQ ID NO: 50

SEQ ID NO: 55 - protein, 2418 aa, Homo sapiens
AGTCCAGCTTGGGTCCCTGAGAGCTGTGAGAAGGAGATGCGGCTGCTGCTGGCCCTGTTGGGGGTCCTGCTGAGTGTGCCTGGGCCTCCAGTCTTGTCCCTGGAGGCCTCTGAGGAAGTGGAGCTTGAGCCCTGCCTGGCTCCCAGCCTGGAGCAGCAAGAGCAGGAGCTGACAGTAGCCCTTGGGCAGCCTGTGCGTCTGTGCTGTGGGCGGGCTGAGCGTGGTGGCCACTGGTACAAGGAGGGCAGTCGCCTGGCACCTGCTGGCCGTGTACGGGGCTGGAGGGGCCGCCTAGAGATTGCCAGCTTCCTACCTGAGGATGCTGGCCGCTACCTCTGCCTGGCACGAGGCTCCATGATCGTCCTGCAGAATCTCACCTTGATTACAGGTGACTCCTTGACCTCCAGCAACGATGATGAGGACCCCAAGTCCCATAGGGACCCCTCGAATAGGCACAGTTACCCCCAGCAAGCACCCTACTGGACACACCCCCAGCGCATGGAGAAGAAACTGCATGCAGTACCTGCGGGGAACACCGTCAAGTTCCGCTGTCCAGCTGCAGGCAACCCCACGCCCACCATCCGCTGGCTTAAGGATGGACAGGCCTTTCATGGGGAGAACCGCATTGGAGGCATTCGGCTGCGCCATCAGCACTGGAGTCTCGTGATGGAGAGCGTGGTGCCCTCGGACCGCGGCACATACACCTGCCTGGTAGAGAACGCTGTGGGCAGCATCCGCTATAACTACCTGCTAGATGTGCTGGAGCGGTCCCCGCACCGGCCCATCCTGCAGGCCGGGCTCCCGGCCAACACCACAGCCGTGGTGGGCAGCGACGTGGAGCTGCTGTGCAAGGTGTACAGCGATGCCCAGCCCCACATCCAGTGGCTGAAGCACATCGTCATCAACGGCAGCAGCTTCGGAGCCGACGGTTTCCCCTATGTGCAAGTCCTAAAGACTGCAGACATCAATAGCTCAGAGGTGGAGGTCCTGTACCTGCGGAACGTGTCAGCCGAGGACGCAGGCGAGTACACCTGCCTCGCAGGCAATTCCATCGGCCTCTCCTACCAGTCTGCCTGGCTCACGGTGCTGCCAGGTACTGGGCGCATCCCCCACCTCACATGTGACAGCCTGACTCCAGCAGGCAGAACCAAGTCTCCCACTTTGCAGTTCTCCCTGGAGTCAGGCTCTTCCGGCAAGTCAAGCTCATCCCTGGTACGAGGCGTGCGTCTCTCCTCCAGCGGCCCCGCCTTGCTCGCCGGCCTCGTGAGTCTAGATCTACCTCTCGACCCACTATGGGAGTTCCCCCGGGACAGGCTGGTGCTTGGGAAGCCCCTAGGCGAGGGCTGCTTTGGCCAGGTAGTACGTGCAGAGGCCTTTGGCATGGACCCTGCCCGGCCTGACCAAGCCAGCACTGTGGCCGTCAAGATGCTCAAAGACAACGCCTCTGACAAGGACCTGGCCGACCTGGTCTCGGAGATGGAGGTGATGAAGCTGATCGGCCGACACAAGAACATCATCAACCTGCTTGGTGTCTGCACCCAGGAAGGGCCCCTGTACGTGATCGTGGAGTGCGCCGCCAAGGGAAACCTGCGGGAGTTCCTGCGGGCCCGGCGCCCCCCAGGCCCCGACCTCAGCCCCGACGGTCCTCGGAGCAGTGAGGGGCCGCTCTCCTTCCCAGTCCTGGTCTCCTGCGCCTACCAGGTGGCCCGAGGCATGCAGTATCTGGAGTCCCGGAAGTGTATCCACCGGGACCTGGCTGCCCGCAATGTGCTGGTGACTGAGGACAATGTGATGAAGATTGCTGACTTTGGGCTGGCCCGCGGCGTCCACCACATTGACTACTATAAGAAAACCAGCAACGGCCGCCTGCCTGTGAAGTGGATGGCGCCCGAGGCCTTGTTTGACCGGGTGTACACACACCAGAGTGACGTGTGGTCTTTTGGGATCCTGCTATGGGAGATCTTCACCCTCGGGGGCTCCCCGTATCCTGGCATCCCGGTGGAGGAGCTGTTCTCGCTGCTGCGGGAGGGACATCGGATGGACCGACCCCCACACTGCCCCCCAGAGCTGTACGGGCTGATGCGTGAGTGCTGGCACGCAGCGCCCTCCCAGAGGCCTACCTTCAAGCAGCTGGTGGAGGCGCTGGACAAGGTCCTGCTGGCCGTCTCTGAGGAGTACCTCGACCTCCGCCTGACCTTCGGACCCTATTCCCCCTCTGGTGGGGACGCCAGCAGCACCTGCTCCTCCAGCGATTCTGTCTTCAGCCACGACCCCCTGCCATTGGGATCCAGCTCCTTCCCCTTCGGGTCTGGGGTGCAGACATGAGCAAGGCTCAAGGCTGTGCAGGCACATAGGCTGGTGGCCTTGGGCCTTGGGGCTCAGCCACAGCCTGACACAGTGCTCGACCTTGATAGCATG

SEQ ID NO: 56 - protein, 762 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPGTGRIPHLTCDSLTPAGRTKSPTLQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 57 - protein, 11 aa, Homo sapiens
IVEYASKGNLR

SEQ ID NO: 58 - protein, 11 aa, Homo sapiens
IVEYASKGNLR

SEQ ID NO: 59 - protein, 11 aa, Homo sapiens
LVEYAAKGNLR

SEQ ID NO: 60 - protein, 11 aa, Homo sapiens
IVECAAKGNLR

What is claimed is:

1. A compound of Formula (I):

I

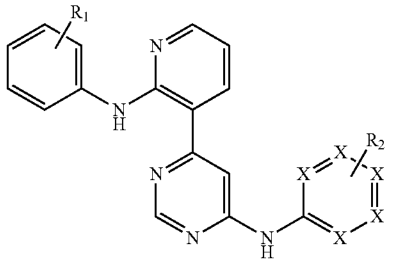

or an optically pure stereoisomer or pharmaceutically acceptable salt thereof, wherein:

each instance of X is independently CH or N;

each instance of $R_1$ is independently halogen or methoxy;

the number of $R_1$ substituents is 1, 2, 3 or 4;

each instance of $R_2$ is independently selected from the group consisting of hydrogen, methyl, amino, propargyloxy,

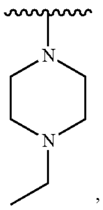
,
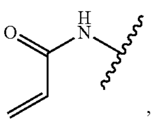
,
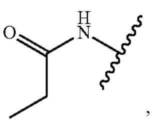
, and
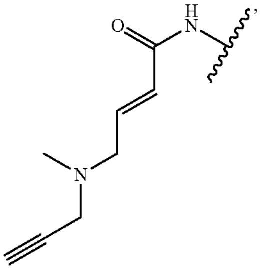
, and the number of $R_2$ substituents is 1 or 2.

2. The compound of claim 1, wherein the compound is:

1

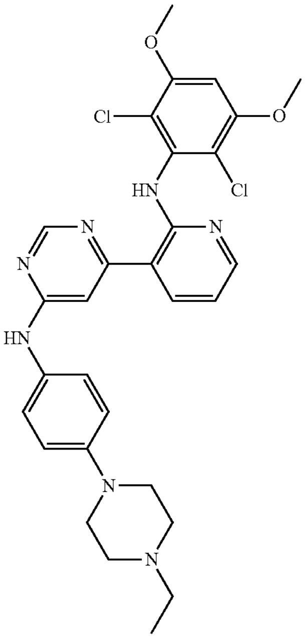

2

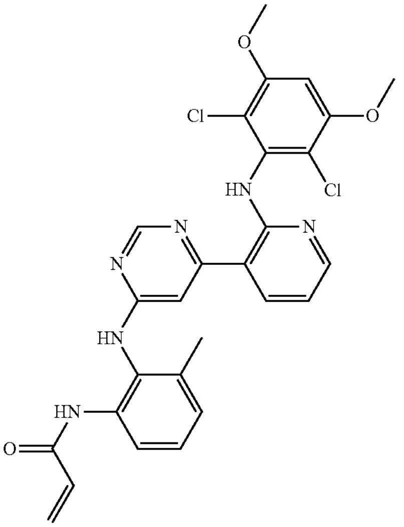

-continued

3

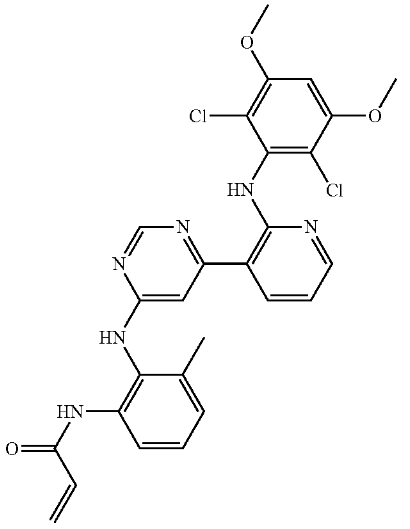

4

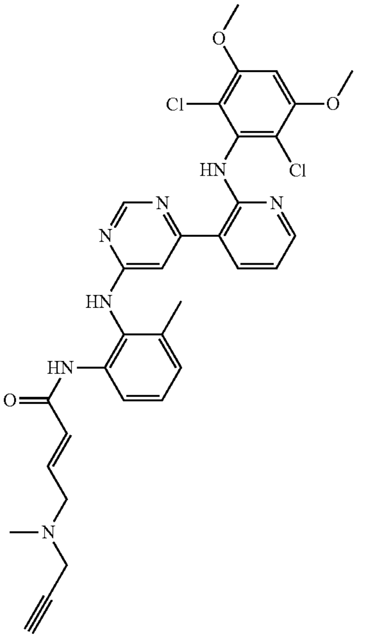

or an optically pure stereoisomer or a pharmaceutically acceptable salt thereof.

3. The compound of claim 1, wherein the compound is selected from 6-(2-((2,6-dichloro-3,5-dimethoxyphenyl)amino)pyridin-3-yl)-N-(4-(4-ethylpiperazin-1-yl)phenyl)pyrimidin-4-amine or N-(2-((6-(2-((2,6-dichloro-3,5-dimethoxyphenyl)amino)pyridin-3-yl)pyrimidin-4-yl)amino)-3-methylphenyl) acrylamide.

4. The compound of claim 1, wherein the compound inhibits a fibroblast growth factor receptor (FGFR).

5. The compound of claim 4, wherein the compound inhibits FGFR4.

6. A method for treating a cancer associated with a FGFR signaling pathway in a subject in need thereof comprising administering a compound of Formula (I) or an optically pure stereoisomer or pharmaceutically acceptable salt thereof to the subject,

I

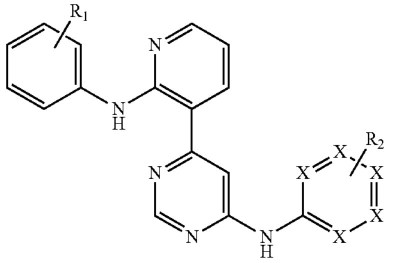

wherein:

each instance of X is independently CH or N;

each instance of $R_1$ is independently halogen or methoxy;

the number of $R_1$ substituents is 1, 2, 3 or 4;

each instance of $R_2$ is independently selected from hydrogen, methyl, amino, propargyloxy,

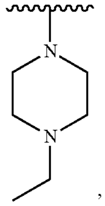 , 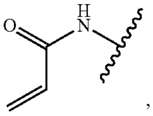 , 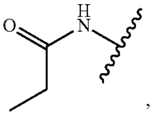 , and

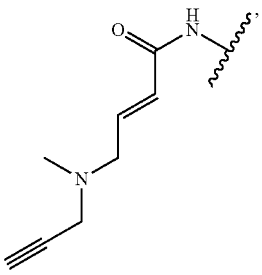 , and the number of $R_2$ substituents is 1 or 2, thereby treating the cancer.

7. The method of claim 6, wherein the compound is:

1

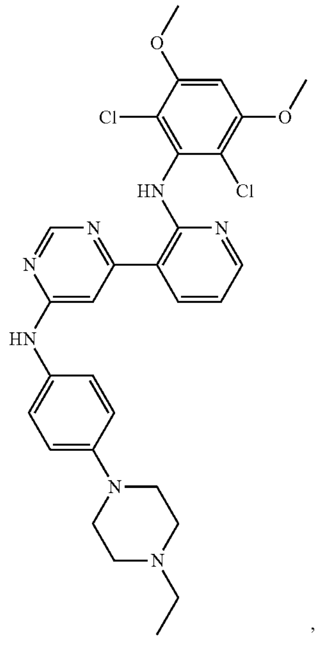 ,

-continued

2

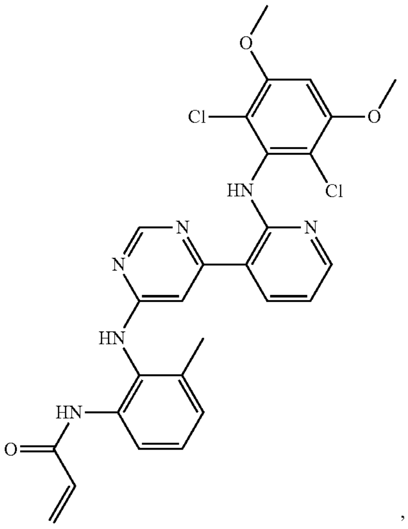

,

3

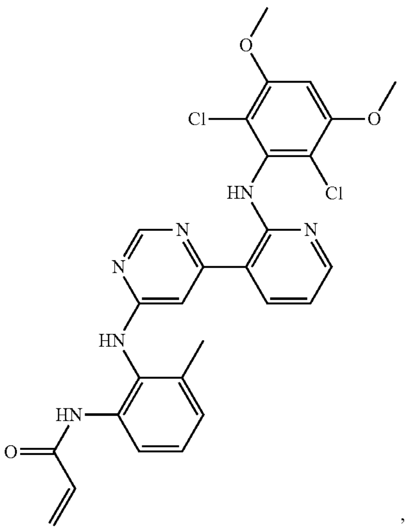

,

-continued

4

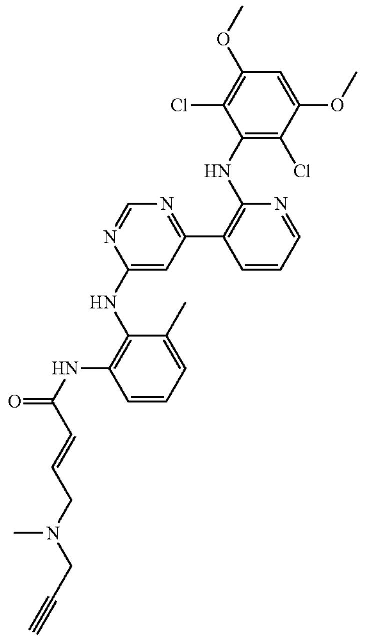

or an optically pure stereoisomer or a pharmaceutically acceptable salt thereof.

8. The method of claim 6, wherein the cancer is selected from the group consisting of breast, lung, bladder, prostate, ovarian, endometrial, rhabdomyosarcoma, liver and gastric.

9. The method of claim 6, wherein the compound inhibits an FGFR.

10. The method of claim 9, wherein the compound inhibits FGFR4.

11. The method of claim 6, wherein the compound targets amino acid residue 484 of SEQ ID NO: 52, amino acid residue 512 of SEQ ID NO: 56, or amino acid residue 552 of SEQ ID NO: 50 or 54.

12. The method of claim 6, further comprising administering a chemotherapeutic agent.

13. The method of claim 12, wherein the compound is administered prior to, simultaneously with or following the administration of the chemotherapeutic agent.

14. A pharmaceutical composition comprising a compound of Formula (I) or an optically pure stereoisomer or pharmaceutically acceptable salt and a pharmaceutically acceptable carrier,

I

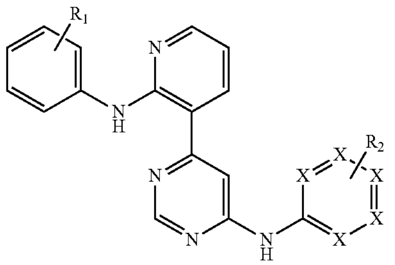

wherein:

each instance of X is independently CH or N;

each instance of $R_1$ is independently halogen or methoxy;

the number of $R_1$ substituents is 1, 2, 3 or 4;
each instance of $R_2$ is independently selected from hydrogen, methyl, amino, propargyloxy,
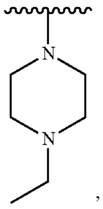
,
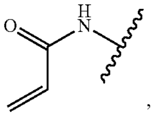
,
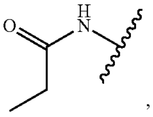
, and
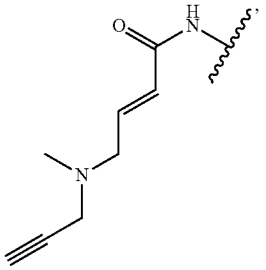
and the number of $R_2$ substituents is 1 or 2.
15. The pharmaceutical composition of claim 14, wherein the compound is:
1
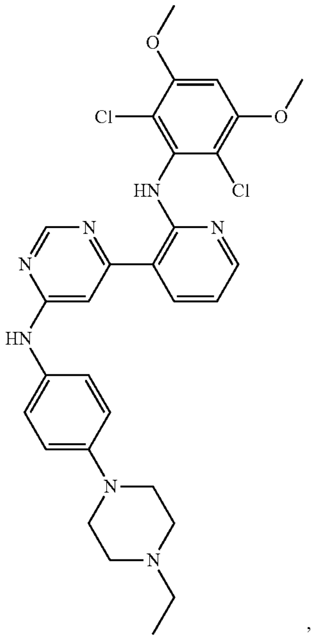
,
-continued
2
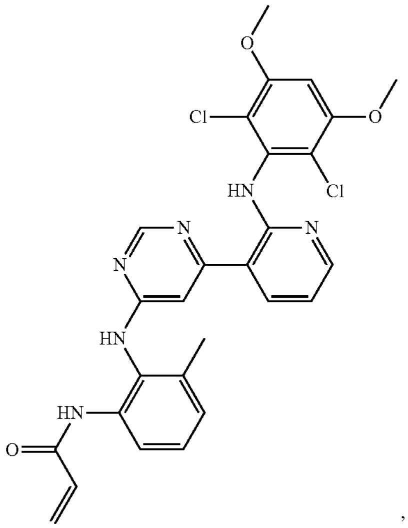
,
3
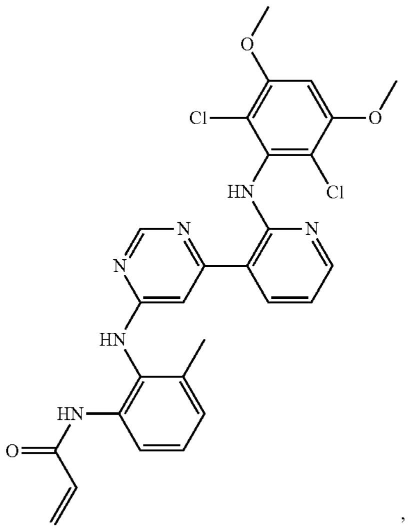
, -continued

4

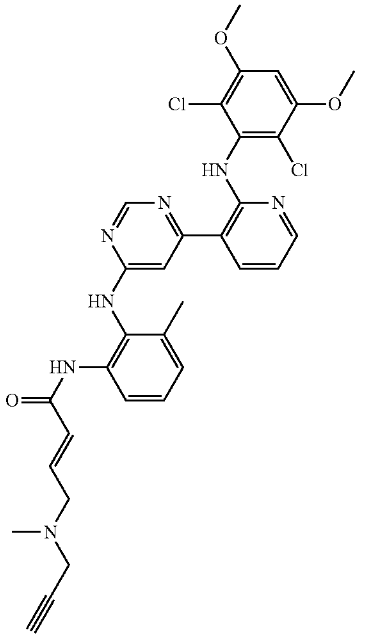

or a pharmaceutically acceptable salt thereof.

16. A method of inhibiting a kinase activity comprising contacting a cell with a compound of Formula (I) or an optically pure stereoisomer or pharmaceutically acceptable salt,

I

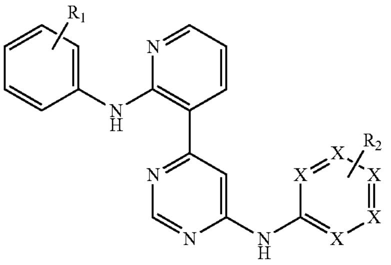

wherein:

each instance of X is independently CH or N;

each instance of $R_1$ is independently halogen or methoxy;

the number of $R_1$ substituents is 1, 2, 3 or 4;

each instance of $R_2$ is independently selected from hydrogen, methyl, amino, propargyloxy,

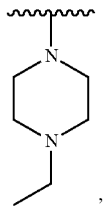

,

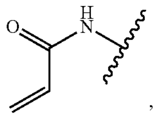

,

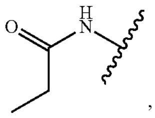

, and

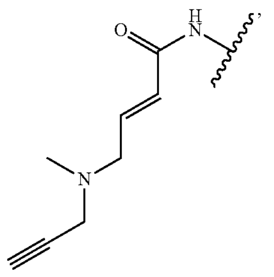

and the number of $R_2$ substituents is 1 or 2, thereby inhibiting the kinase activity.

17. The method of claim 16, wherein the compound is:

1

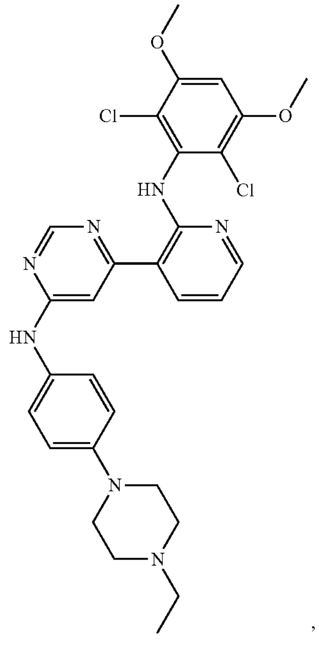

,

-continued

2

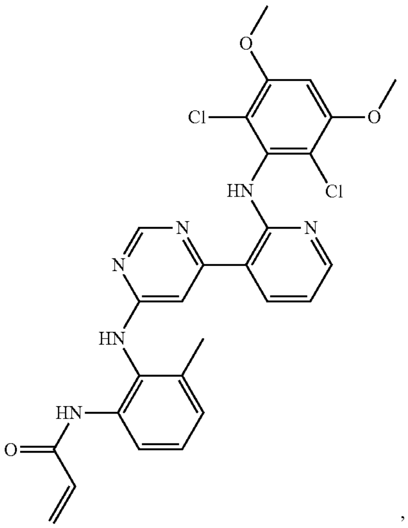

,

3

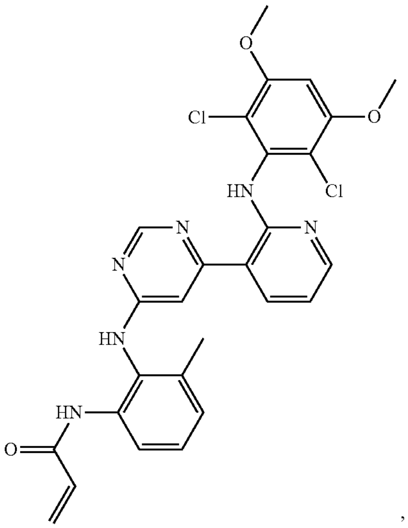

,

-continued

4

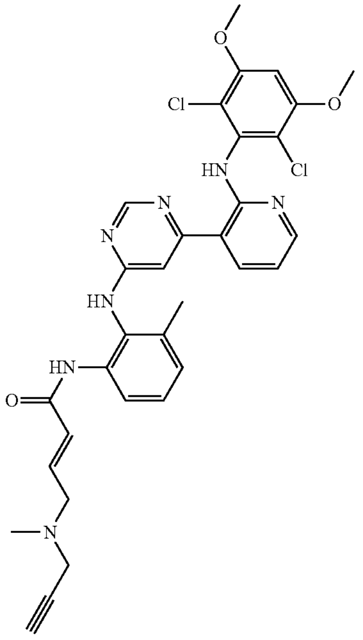

or an optically pure stereoisomer or a pharmaceutically acceptable salt thereof.

18. The method of claim 16, wherein the kinase is selected from the group consisting of Anaplastic lymphoma kinase (ALK), Epidermal growth factor receptor (EGFR), Ephrin type-3 receptor 3 (EPH-B3), Focal adhesion kinase (FAK), Fibroblast growth factor receptor 1 (FGFR1), Fibroblast growth factor receptor 2 (FGFR2), Fibroblast growth factor receptor 3 (FGFR3), Fibroblast growth factor receptor 4 (FGFR4), Mast/stem cell growth factor receptor (SCFR or KIT), Mitogen-activated protein kinase kinase 1 (MAP2K1 or MEK1), Hepatocyte growth factor receptor (HGFR or MET), Platelet-derived growth factor receptor alpha (PDG-FRA), Platelet-derived growth factor receptor beta (PDG-FRB),Proto-oncogene tyrosine kinase receptor (RET), Proto-oncogene tyrosine-protein kinase (ROS) and Tyrosine-protein kinase receptor (TYRO 3).

19. The method of claim 18, wherein the kinase is FGFR1, FGFR2, FGFR3 and/or FGFR4.

20. The method of claim 19, wherein the kinase is FGFR4.

21. The method of claim 16, wherein the cell is a cancer cell.

22. The method of claim 21, wherein the cancer cell is a breast, lung, bladder, prostate, ovarian, endometrial, rhabdomyosarcoma, liver or gastric cancer cell.

23. A method of treating a cancer associated with a FGFR signaling pathway comprising administering to a subject in need thereof a compound of claim 1.

* * * * *